United States Patent

Apel et al.

(10) Patent No.: US 9,410,965 B2
(45) Date of Patent: Aug. 9, 2016

(54) IDENTIFICATION OF DISCRIMINANT PROTEINS THROUGH ANTIBODY PROFILING, METHODS AND APPARATUS FOR IDENTIFYING AN INDIVIDUAL

(75) Inventors: William A. Apel, Jackson, WY (US); Vicki S. Thompson, Idaho Falls, ID (US); Jeffrey A. Lacey, Idaho Falls, ID (US); Cynthia A. Gentillon, Idaho Falls, ID (US)

(73) Assignee: Battelle Energy Alliance, LLC, Idaho Falls, ID (US)

(*) Notice: Subject to any disclaimer, the term of this patent is extended or adjusted under 35 U.S.C. 154(b) by 814 days.

(21) Appl. No.: 12/883,002

(22) Filed: Sep. 15, 2010

(65) Prior Publication Data

US 2011/0065601 A1   Mar. 17, 2011

Related U.S. Application Data

(63) Continuation-in-part of application No. 12/586,109, filed on Sep. 17, 2009, now Pat. No. 8,969,009.

(51) Int. Cl.
*G01N 33/53* (2006.01)
*G01N 33/68* (2006.01)

(52) U.S. Cl.
CPC .................................. *G01N 33/6845* (2013.01)

(58) Field of Classification Search
None
See application file for complete search history.

(56) References Cited

U.S. PATENT DOCUMENTS

| | | | |
|---|---|---|---|
| 566,558 A | 8/1896 | Bell | |
| 4,235,869 A | 11/1980 | Schwarzberg | |
| 4,542,104 A | 9/1985 | Stryer et al. | |
| 4,880,750 A | 11/1989 | Francoeur | |
| 5,238,652 A | 8/1993 | Sun et al. | |
| 5,270,167 A * | 12/1993 | Francoeur | 435/7.21 |
| 5,281,521 A | 1/1994 | Trojanowski et al. | |
| 5,445,934 A | 8/1995 | Fodor et al. | |
| 5,471,549 A | 11/1995 | Kurosu et al. | |
| 5,529,922 A | 6/1996 | Chapman et al. | |
| 5,541,113 A | 7/1996 | Siddigi et al. | |
| 5,605,662 A | 2/1997 | Heller et al. | |
| 5,744,305 A | 4/1998 | Fodor et al. | |
| 5,858,801 A | 1/1999 | Brizzolara | |
| 5,885,780 A | 3/1999 | Olivera et al. | |
| 5,888,813 A | 3/1999 | Endl et al. | |
| 6,103,479 A | 8/2000 | Taylor | |
| 6,553,135 B1 | 4/2003 | Ring et al. | |
| 6,591,193 B2 | 7/2003 | Krebs et al. | |
| 6,591,196 B1 | 7/2003 | Yakhini et al. | |
| 6,906,104 B2 | 6/2005 | Schostarez et al. | |
| 6,965,704 B2 | 11/2005 | Kaushikkar et al. | |
| 6,980,677 B2 | 12/2005 | Niles et al. | |
| 6,989,276 B2 | 1/2006 | Thompson et al. | |
| 7,219,016 B2 | 5/2007 | Rimm et al. | |
| 7,682,797 B2 | 3/2010 | Thompson et al. | |
| 7,682,798 B2 | 3/2010 | Thompson et al. | |
| 7,695,919 B2 | 4/2010 | Apel et al. | |
| 8,014,577 B2 | 9/2011 | Bouchard et al. | |
| RE44,031 E | 2/2013 | Apel et al. | |
| RE44,539 E | 10/2013 | Thompson et al. | |
| 8,969,009 B2 | 3/2015 | Thompson et al. | |
| 2002/0127623 A1 * | 9/2002 | Minshull et al. | 435/7.92 |
| 2002/0168699 A1 | 11/2002 | Thompson et al. | |
| 2003/0073149 A1 | 4/2003 | Archer et al. | |
| 2003/0093225 A1 | 5/2003 | Fathallah-Shaykh | |
| 2004/0014044 A1 | 1/2004 | Scott et al. | |
| 2004/0047499 A1 | 3/2004 | Shams | |
| 2004/0063220 A1 | 4/2004 | Lebrun | |
| 2004/0085443 A1 | 5/2004 | Kallioneimi et al. | |
| 2005/0042696 A1 | 2/2005 | Kovalenko | |
| 2005/0047678 A1 | 3/2005 | Jones et al. | |
| 2005/0054118 A1 | 3/2005 | Lebrun | |
| 2005/0078860 A1 | 4/2005 | Minor | |

(Continued)

FOREIGN PATENT DOCUMENTS

| | | |
|---|---|---|
| CA | 2685997 | 10/2013 |
| GB | 2190490 | 11/1987 |

(Continued)

OTHER PUBLICATIONS

Identity Sciences, "Identity Sciences LLC Introduces a Non-DNA Human Identification Test with Results Available in Two Hours," Apr. 16, 2008. Retrieved from the internet May 10, 2011: <URL: http://www.identitysciences.com/releases/IDS_04-16-08.pdf> p. 1.

PCT International Search Report and Written Opinion of the International Searching Authority for PCT/US10/49227, dated May 25, 2011, 14 pages.

Bernstein et al., Cellular Protein and RNA Antigens in Autoimmune Disease, 2 Mol. Biol. Med. 105-120 (1984).

Boguslaski et al., Clinical Immunochemistry: Principles of Methods and Applications, (1984).

(Continued)

*Primary Examiner* — Ann Lam
(74) *Attorney, Agent, or Firm* — TraskBritt

(57) ABSTRACT

A method for determining a plurality of proteins for discriminating and positively identifying an individual based from a biological sample. The method may include profiling a biological sample from a plurality of individuals against a protein array including a plurality of proteins. The protein array may include proteins attached to a support in a preselected pattern such that locations of the proteins are known. The biological sample may be contacted with the protein array such that a portion of antibodies in the biological sample reacts with and binds to the proteins forming immune complexes. A statistical analysis method, such as discriminant analysis, may be performed to determine discriminating proteins for distinguishing individuals. Proteins of interest may be used to form a protein array. Such a protein array may be used, for example, to compare a forensic sample from an unknown source with a sample from a known source.

17 Claims, 1 Drawing Sheet

(56) References Cited

U.S. PATENT DOCUMENTS

| | | | |
|---|---|---|---|
| 2005/0202421 A1* | 9/2005 | Hirsch et al. | 435/6 |
| 2005/0203708 A1 | 9/2005 | Ghosh | |
| 2005/0208529 A1 | 9/2005 | Winther et al. | |
| 2006/0057741 A1 | 3/2006 | Thompson et al. | |
| 2006/0115429 A1 | 6/2006 | Afeyan et al. | |
| 2006/0223131 A1 | 10/2006 | Schweitzer et al. | |
| 2006/0247867 A1 | 11/2006 | Delenstarr et al. | |
| 2006/0257396 A1 | 11/2006 | Jacobsen | |
| 2007/0190585 A1 | 8/2007 | Apel et al. | |
| 2008/0058215 A1 | 3/2008 | Kim et al. | |
| 2008/0144899 A1 | 6/2008 | Varma et al. | |
| 2008/0200796 A1 | 8/2008 | Graham et al. | |
| 2008/0286881 A1 | 11/2008 | Apel et al. | |
| 2008/0298667 A1 | 12/2008 | Lassahn et al. | |
| 2008/0300796 A1 | 12/2008 | Lassahn et al. | |
| 2009/0042213 A1 | 2/2009 | Hoofnagle et al. | |
| 2009/0047281 A1 | 2/2009 | Sherman | |
| 2011/0065594 A1* | 3/2011 | Thompson et al. | 506/9 |
| 2011/0065601 A1 | 3/2011 | Apel et al. | |
| 2011/0256638 A1 | 10/2011 | Chan et al. | |

FOREIGN PATENT DOCUMENTS

| | | |
|---|---|---|
| JP | 61122223 | 6/1986 |
| WO | 9729206 | 8/1977 |
| WO | 86/02734 | 5/1986 |
| WO | 90/05296 | 5/1990 |
| WO | 97/29206 | 8/1997 |
| WO | 9831839 | 7/1998 |
| WO | 9838490 | 9/1998 |
| WO | 9938985 | 8/1999 |
| WO | 03052422 | 6/2003 |
| WO | 2007031874 | 3/2007 |
| WO | 2008118558 | 10/2008 |
| WO | 2008144085 | 11/2008 |
| WO | 2011037827 | 3/2011 |

OTHER PUBLICATIONS

Cabilly, Combinatorial Peptide Library Protocols, Humana Press, 304 p.p. 129 154 (1997).
Cwirla et al., Peptides on Phage: A Vast Library of Peptides for Identifying Ligands, 87 Proc. Nat'l Acad. Sci. USA 6378-6382 (1990).
Devlin et al., Random Peptide Libraries: A Source of Specific Protein Binding Molecules, 249 Science 404-406 (1990).
Fodor, P. S., 277 Science 393-395 (1997).
Francoeur et al., Identification of Ki (Ku, p. 70/p. 80) Autoantigens and Analysis of Anti-Ki Autoantibody Reactivity, 136 J. Immunol. 1648 (1986).
Francoeur, A. M., Antibody Fingerprinting: A Novel Method for Identifying Individual People and Animals, 6 Bio/technology 821-825 (1988).
Good et al., Hydrogen Ion Buffers, 24 Methods Enzymology 53-68 (1972).
Han et al., Detection of Analyte Binding to Microarrays Using Gold Nanoparticle Labels and a Desktop Scanner, 3 Lab Chip 329; 329-332 (2003).
Hemmila, I., Fluoroimmunoassays and Immunofluorometric Assays, 31 Clin. Chem. 359 (1985).
Invitrogen, "Antibody Profiling on Invitrogen ProtoArray, High-Density Protein Microarrays," Application Note, <www.invitrogen.com/protoarray> (2005) 6 pages.
Invitrogen, "ProtoArray Immune Response Biomarker Profiling Application Kit," User Manual, Catalog No. PA016, Version A, Sep. 13, 2006, 36 pages.
Kemeny et al., ELISA and Other Solid Phase Immunoassays, (John Wiley & Sons Ltd.) (1988).
Lam et al., A New Type of Synthetic Peptide Library for Identifying Ligand-binding Activity, 354 Nature 82-84 (1991).
Leland et al., Electrogenerated Chemiluminescence: An Oxidative-Reduction Type ECL Reactions Sequence Using Triprophyl Amine, 137 J. Electrochemical Soc. 3127-3131 (1990).
Michaud, et al., "Biomarker Identification Using ProtoArray High Density Protein Microarrays: Profiling Auto-antibodies in Disease," Application Note, <www.invitrogen.com/protoarray> (2005) 6 pages.
Persoon, T., "Immunochemical Assays in the Clinical Laboratory," 5 Clinical Laboratory Science 31 (1992).
Petrik, J., "Microarray technology: the future of blood testing?" Review, Blackwell Science Ltd. Vox Sanguinis (2001) 80, pp. 1-11.
Predki et al., "Protein microarrays: A new tool for profiling antibody cross-reactivity," Human Antibodies, IOS Press, 14 (2005) pp. 7-15.
Ryder, Stacey, "Microarrays Provide Fast and Sensitive Genetic Fingerprint for Forensic Investigations," Affymetrix Microarray Bulletin, Sequence Analysis, vol. 1, Issue 4, pp. 1-5 (Oct. 2005).
Santangelo et al., Cloning of Open Reading Frames and Promoters from the *Saccharomyces cerevisiae* Genome: Construction of Genomic Libraries of Random Small Fragments, 46 Gene 181-186 (1986).
Scott et al., Searching for Peptide Ligands with an Epitope Library, 249 Science 386 (1990).
Stites et al., Basic and Clinical Immunology, (1994).
Thompson et al., Antibody profiling as an identification tool for forensic samples, 3576 Investigation and Forensic Science Technologies 52-59 (1999).
Thompson et al., Fiber-Optic Immunosensor for the Detection of Fumonisin B1, 44 J. Agric. Food Chem. 1041-1046 (1996).
Unger et al., Individual-specific Antibody Profiles as a Means of Newborn Infant Identification, 15 J. Perinatology 152-155 (1995).
Wong, S. S., Chemistry of Protein Conjugation and Cross Linking CRC Press, 340 (1991).
Young et al., Yeast RNA Polymerase II Genes: Isolation with Antibody Probes, 222 Science 778-782 (1983).
International Search Report and Written Opinion for serial No. PCT/US08/53641, filed Feb. 12, 2008, mailed Sep. 8, 2008, 8 pgs.
Thompson, Vicki; U.S. Patent Application entitled: Identification of discriminant proteins through antibody profiling, methods, and apparatus for identifiying an individual, having U.S. Appl. No. 12/586,109, filed Sep. 17, 2009, 41 pgs.
Thompson, Vicki; Restriction Requirement for U.S. Appl. No. 12/586,109, filed Sep. 17, 2009, mailed Jun. 29, 2012, 8 pgs.
Thompson, Vicki; U.S. Patent Application entitled: Rapid Classificaiton of Biological Components, having U.S. Appl. No. 11/101,216, filed Apr. 6, 2005, 48 pgs.
Thompson, Vicki; Non-Final Office Action for U.S. Appl. No. 11/101,216, filed Apr. 6, 2005, mailed May 8, 2007, 21 pgs.
Thompson, Vicki; Final Office Action for U.S. Appl. No. 11/101,216, filed Apr. 6, 2005, mailed Oct. 19, 2007, 13 pgs.
Thompson, Vicki; Non-Final Office Action for U.S. Appl. No. 11/101,216, filed Apr. 6, 2005, mailed Mar. 13, 2008, 13 pgs.
Thompson, Vicki; Final Office Action for U.S. Appl. No. 11/101,216, filed Apr. 6, 2005, mailed Sep. 30, 2008, 15 pgs.
Thompson, Vicki; Non-Final Office Action for U.S. Appl. No. 11/101,216, filed Apr. 6, 2005, mailed Feb. 25, 2009, 17 pgs.
Thompson, Vicki; Notice of Allowance for U.S. Appl. No. 11/101,216, filed Apr. 6, 2005, mailed Sep. 22, 2009, 11 pgs.
Thompson, Vicki; Issue Notification for U.S. Appl. No. 11/101,216, filed Apr. 6, 2005, mailed Mar. 3, 2010, 1 pg.
Apel, William; U.S. Patent Application entitled: Antibody Profiling Sensitivity Through Increased Reporter Antibody Layering, having U.S. Appl. No. 11/691,096, filed Mar. 26, 2007, 46 pgs.
Apel, William; Restriction Requirement for U.S. Appl. No. 11/691,096, filed Mar. 26, 2007, mailed Aug. 20, 2008, 9 pgs.
Apel, William; Non-Final Office Action for U.S. Appl. No. 11/691,096, filed Mar. 26, 2007, mailed Dec. 29, 2008, 30 pgs.
Apel, William; Notice of Allowance for or U.S. Appl. No. 11/691,096, filed Mar. 26, 2007, mailed Jul. 15, 2009, 6 pgs.
Apel, William; Examiner Interview Summary Record for U.S. Appl. No. 11/691,096, filed Mar. 26, 2007, mailed Aug. 25, 2009, 2 pgs.
Apel, William; Issue Notification for or U.S. Appl. No. 11/691,096, filed Mar. 26, 2007, mailed Dec. 23, 2009, 1 pgs.
Apel, William; Notice of Allowance for or U.S. Appl. No. 11/691,096, filed Mar. 26, 2007, mailed Jan. 28, 2010, 10 pgs.
Apel, William; Issue Notification for or U.S. Appl. No. 11/691,096, filed Mar. 26, 2007, mailed Mar. 24, 2010, 1 pgs.

(56) References Cited

OTHER PUBLICATIONS

Apel, William; U.S. Patent Re-issue Application entitled: Antibody Profiling Sensitivity Through Increased Reporter Antibody Layering, having U.S. Appl. No. 13/439,400, filed Apr. 4, 2012, 22 pgs.
Apel, William; Notice of Allowance for U.S. Appl. No. 13/439,400, filed Apr. 4, 2012, mailed Oct. 17, 2012, 18 pgs.
Apel, William; Issue Notification for U.S. Appl. No. 13/439,400, filed Apr. 4, 2012, mailed Feb. 6, 2013, 1 pg.
Apel, William; U.S. Patent Continuation Re-Issue Application entitled: Improved Antibody Profiling Sensitivity Through Increased Reporter Antibody Layering, having U.S. Appl. No. 13/771,915, filed Feb. 20, 2013, 24 pgs.
Lacey, Jeffrey A.; U.S. Provisional Patent Application entitled: Computing Systems, Computer-Readable Media and Methods of Antibody Profiling, U.S. Appl. No. 61/786,961, filed Mar. 15, 2013, 60 pgs.
Apel, William A.; U.S. Patent Application entitled: Antibody Profiling, Methods and Apparatus for Identifying an Individual or Source of a Biological Material, U.S. Appl. No. 13/832,406, filed Mar. 15, 2013; 53 pgs.
Thompson, Vicki; U.S. Patent Application entitled: Rapid Classification of Biological Components, having U.S. Appl. No. 10/017,577, filed Dec. 14, 2001, 58 pgs.
Thompson, Vicki; Restriction Requirement for U.S. Appl. No. 10/017,577, filed Dec. 14, 2001, mailed Jun. 29, 2004, 7 pgs.
Thompson, Vicki; Restriction Requirement for U.S. Appl. No. 10/017,577, filed Dec. 14, 2001, mailed Oct. 20, 2004, 8 pgs.
Thompson, Vicki; Notice of Allowance for U.S. Appl. No. 10/017,577, filed Dec. 14, 2001, mailed Jan. 25, 2005, 13 pgs.
Thompson, Vicki; U.S. Patent Re-issue Application entitled: Rapid Classification of Biological Components, having U.S. Appl. No. 13/425,181, filed Mar. 20, 2012, 24 pgs.
Thompson, Vicki; Non-Final Office Action for U.S. Appl. No. 13/425,181, filed Mar. 20, 2012, mailed Sep. 5, 2012, 28 pgs.
Thompson, Vicki; U.S. Patent Application entitled: Rapid Classification of Biological Components, having U.S. Appl. No. 11/101,254, filed Apr. 6, 2005, 48 pgs.
Thompson, Vicki; Non-Final Office Action for U.S. Appl. No. 11/101,254, filed Apr. 6, 2005, mailed May 2, 2007, 19 pgs.
Thompson, Vicki; Non-Final Office Action for U.S. Appl. No. 11/101,254, filed Apr. 16, 2005, mailed Oct. 4, 2007, 12 pgs.
Thompson, Vicki; Non-Final Office Action for U.S. Appl. No. 11/101,254, filed Apr. 6, 2005, mailed Mar. 17, 2008, 15 pgs.
Thompson, Vicki; Final Office Action for U.S. Appl. No. 11/101,254, filed Apr. 6, 2005, mailed Sep. 5, 2008, 15 pgs.
Thompson, Vicki; Advisory Action for U.S. Appl. No. 11/101,254, filed Apr. 6, 2005, mailed Dec. 2, 2008, 17 pgs.
Thompson, Vicki; Non-Final Office Action for U.S. Appl. No. 11/101,254, filed Apr. 6, 2005, mailed Dec. 17, 2008, 17 pgs.
Thompson, Vicki; Notice of Allowance for U.S. Appl. No. 11/101,254, filed Apr. 6, 2005, mailed Aug. 10, 2009, 7 pgs.
Thompson, Vicki; Issue Notification for U.S. Appl. No. 11/101,254, filed Apr. 6, 2005, mailed Mar. 23, 2010, 1 pg.
Apel, William A.; U.S. Patent Application entitled: Compositions and Methods for Combining Report Antibodies, having U.S. Appl. No. 11/748,361, filed May 14, 2007, 57 pgs.
Apel, William; Non-Final Office Action for U.S. Appl. No. 11/748,361, filed May 14, 2007, mailed Oct. 2, 2009, 13 pgs.
Apel, William; Final Office Action for U.S. Appl. No. 11/748,361, filed May 14, 2007, mailed Mar. 18, 2010, 16 pgs.
Apel, William; Non-Final Office Action for U.S. Appl. No. 11/748,361, filed May 14, 2007, mailed Jun. 10, 2010, 10 pgs.
Apel, William; Final Office Action for U.S. Appl. No. 11/748,361, filed May 14, 2007, mailed Nov. 24, 2010, 13 pgs.
Canada Office Action for serial No. 2,685,997, filed Feb. 12, 2008, mailed Mar. 14, 2012, 2 pgs.
Hellstrom, et al; "Epitope mapping and use of anti-idiotypic antibodies to the L6 monoclonal anticarcinoma antibody", Cancer Research 50, 1990, p. 2449-2454.

Thompson, Vicki S.; Non-Final Office Action for U.S. Appl. No. 12/586,109, filed Sep. 17, 2009, mailed Apr. 15, 2013, 19 pgs.
Thompson, Vicki; Advisory Action for U.S. Appl. No. 11/101,216, filed Apr. 6, 2005, mailed Dec. 31, 2008, 17 pgs.
Extended European Search Report for serial No. 10819278.2, filed Mar. 28, 2012, mailed Jun. 28, 2013, 10 pgs.
Apel, William A.; Non-Final Office Action for U.S. Appl. No. 11/748,361, filed May 14, 2007, mailed Oct. 3, 2013, 63 pgs.
Harlow, et al. 1988. Antibodies, A Laboratory Manual, Cold Spring Harbor Laboratory, Cold Spring Harbor. pp. 319, 321, and 344.
Mokry, 1996. Versatility of Immunohistochemical Reactions: Comprehensive Survey of Detection Systems. ACTA Medica 39: pp. 129-140.
Thompson, et al; "Forensic Validation Study of Antibody Profiling Identification", Idaho National Engineering and Environmental Laboratory, FRENZY—Forensic Science and Crime Scene Technology, Conference and Expo, Washington, D.C., May 14-17, 2001, 24 pg.
Thompson, et al; "Novel Assay for Drug and Identity Determination of Body Fluids", Idaho National Engineering and Environmental Laboratory, American Academy of Forensic Sciences Annual Meeting, Reno, Feb. 22-26, 2000, 2 pgs.
Thompson, et al; "Antibody profiling as an identification tool for forensic samples," Proceedings of SPIE Reprint, Nov. 3-4, 1998, 9 pgs.
Unlu et al., "Difference gel electrophoresis: A single gel method for detecting changes in protein extracts," Electrophoresis, vol. 18; 1997; pp. 2071-2077.
Agg et al., "Preliminary Investigations into Tris (2,2'-bipyridyl) Ruthenium (III) as a Chemiluminescent Reagent for the Detection of 3,6-Diacetylmorphine (Heroin) on Surfaces," Journal of Forensic Science, Sep. 2007, vol. 52, No. 5, p. 1111-1114.
Ascher et al., "Determination of the Etiology of Seroreversals in HIV Testing by Antibody Fingerprinting", Journal of Acquired Immune Deficiency Syndromes, 6:241-244 (1993) Raven Press, Ltd, NY.
Baird, Jeffrey, Forensic DNA in the Trial Court 1990-1992: A Brief History, pp. 61-75.
Bernard et al., "Micromosaic Immunoassays," Analytical Chemistry vol. 73, 2001, pp. 8-12.
BioDiscovery, Inc.; "ImaGene User Manual", Version 7, 1996-2006, 8 pgs.
Bowers, Larry D., "Athletic Drug Testing", Sport Pharmacology, 1998, p. 299-319.
Cambridge Healthtech Institute's Fourth Annual, DNA Forensics (Brochure), 2000, 6 pgs.
Caterino-De-Araujo et al., "Sensitivity of Two Enzyme-linked Immunosorbent Assay Tests in Relation to Western Blot in Detecting Human T-Cell Lymphotropic Virus Types I and II Infection among HIV-1 Infected Patients from Sao Paulo, Brazil," Diagnostic Microbiol Infect Dis; 1998; 30; 173-182; 10 pgs.
Cone, Edward; "Salvia Testing for Drugs of Abuse", ANNALS New York Academy of Sciences, 1995, p. 91-127.
Controversy Over Forensic DNA Analysis, Science in the Courtroom, QC Researcher, pp. 924-925, Oct. 22, 1993.
Derisi et al., "Exploring the Metabolic and Genetic Control of Gene Expression on a Genomic Scale," Science, vol. 278; Oct. 24, 1997; pp. 680-686.
Dow et al., "Automatic Multiparameter Fluorescence Imaging for Determining Lymphocyte Phenotype and Activation Status in Melanoma Tissue Sections," Cytometry, vol. 25; 1996, pp. 71-81.
Eisen, M. "ScanAlyze User Manual," 1999, Retrieved from http://rana.lbl.gov/manuals/ScanAiyzeDoc.pdf on Nov. 6, 2009.
International Preliminary Report on Patentability for serial No. PCT/US02/39027, filed Nov. 25, 2002, mailed Mar. 19, 2004, 8 pgs.
International Preliminary Report on Patentability for serial No. PCT/US2008/065339, filed May 30, 2008, mailed Dec. 1, 2009, 6 pgs.
International Preliminary Report on Patentability for serial No. PCT/US2008/054011, filed Feb. 14, 2008, mailed Sep. 29, 2009, 8 pgs.
International Preliminary Report on Patentability for serial No. PCT/US2008/065321, filed May 30, 2008, mailed Dec. 1, 2009, 8 pgs.
International Search Report and Written Opinion for serial No. PCT/US08/65339, filed May 30, 2008, mailed Jan. 28, 2009, 5 pgs.

(56) References Cited

OTHER PUBLICATIONS

International Search Report and Written Opinion for serial No. PCT/US2008/065321, filed May 30, 2008, mailed Jan. 16, 2009, 7 pgs.
International Search Report and Written Opinion for serial No. PCT/US08/54011, filed Feb. 14, 2008, mailed Oct. 21, 2008, 8 pgs.
International Search Report and Written Opinion for serial No. PCT/US02/039027, filed Nov. 25, 2002, mailed Mar. 13, 2013, 6 pgs.
Karch. S. B., Drug Abuse Handbook, CRC Press, 1998, p. 727-798.
Kemeny, et al; "Advances in ELISA and other solid-phase immunoassays", Immunology Today, vol. 7, No. 3 1986, 2 pgs.
Kidwell, et al; "Testing for drugs of abuse in saliva and sweat", Jounral of Chromatography B, vol. 173, 1998, p. 111-135.
Mccabe, John; "DNA Fingerprinting: The Failings of Frye", Westlaw, 16 N. Ill. U. L. Rev. 455, pp. 455-481.
Miragen, "Antibody Profile Assay", Advertisement, 1996, 1 pg.
Parry, Tests for HIV and hepatitis viruses, 694 Annals N.Y Acad. Sci. 221, 1993, 18 pgs.
Peat et al., "Analytical Considerations and Approaches for Drugs", Drug Abuse Handbook, 1998, p. 751-764.
Sanchez-Carbayo, Marta: "Antibody arrays: Technical considerations and clinical applications in cancer," Clinical Chemistry, vol. 52, No. 9, Sep. 2006, pp. 1651-1659.
Schramm et al.. "Drugs of Abuse in Saliva: A Review", 16 J. Anal. Toxicology, 1992, p. 1-9.
Supplementary European Search Report from EP 08 72 9906 dated Mar. 25, 2010; 5 pgs.
Thompson et al., "A Novel Test for Detection of Drugs in the Body That Also Provides the Identity of the Person Being Examined," ONDCP International Technology Symposium Jun. 25-28, 2001, 10 pgs.
Thompson et al., "Antibody Profiling Technique for Rapid Identification of Forensic Samples," CAT/NWAFS/SWAFS/SAT Combined Professional Training Seminar, Las Vegas, Nov. 3-7, 1997, 19 pgs.
Supplementary European Search Report for serial No. EP08780412, filed Feb. 12, 2008, mailed Nov. 8, 2010; 13 pgs.
Shin Masashi et al; "Multilayer peroxidase-labeled antibody method: Comparison with labeled streptavidin-biotin method, avidin-biotin-peroxidase complex method, and peroxidase-antiperoxidase method" Journal of Clinical Laboratory Analysis, vol. 9, No. 6, 1995, pp. 424-430, XP002608579.
Morgan A C Jr et al: Monoclonal antibodies to human melanoma-associated antigens: an amplified enzyme-linked immunosorbent assay for the detection of antigen, antibody, and immune complexes Cancer Research, American Association for Cancer Rerearch, US, vol. 43, No. 7, Jul. 1, 1983, pp. 3155-3159, XP009140641.
Linsenmayer T F et al: "Multiple Reaction 11-5 Cycling a Method for Enhancement of the Immunochemical Signal of Monoclonal Antibodies" Journal of Histochemistry and Cytochemistry, vol. 36, No. 8, 1988, pp. 1075-1078.
McQuaid et al: "Detection protocols for 11-5 biotinylated probes: optimization using multistep techniques." The Journal of Histochemistry and Cytochemistry : Official Journal of the Histochemistry Society Apr. 1992 LNKID• PubMed:1552190, vol. 40, No. 4, Apr. 1992, pp. 569-574, XP002608581.
Butler; The amplified ELISA: principles of and applications for the comparative quantitation of class and subclass antibodies and the distribution of antibodies and antigens in biochemical separates. Methods in Enzymology; [Methods in Enzymology], Academic Press Inc, San Diego, CA US LNKD—DOI:10:1016/0076-6879(81)73087-8, vol, 73, No. Part B, Jan. 1, 1981 pp. 482-523, XP009140635.
Canadian Office Action for serial No. 2,679,573, filed Feb. 14, 2008, mailed Aug. 23, 2012, 4 pgs.
Aurell, et al; "Rapid Detection and Enumeration of Legionella pneumophila in Hot Water Systems by Solid-Phase Cytometry," Applied and Environmental Microbiology, Mar. 2004, p. 1651-1657.
Tuson, et al.; "A novel immunohistochemical technique for demonstration of specific binding of human monoclonal antibodies to human cryostat tissue sections". The Journal of Histochemistry and Cytochemistry, vol. 38, No. 7, 1990, p. 923-926.
Brown, et al; "Primary antibody-Fab fragment complexes: a flexible alternative to traditional direct and indirect immunolabeling techniques", Journal of Histochemistry and Cytochemistry, vol. 52(9): 2004, p. 1219-1230.
Habb, et al; "Protein microarrays for highly parallel detection and quantitation of specific proteins and antibodies in complex solutions." Genome Biology 2001, 2(2):research0004.1-0004.13, 13 pgs.
Gaseitsiwe et al; "Pattern Recognition in Pulmonary Tuberculosis Defined by High Content Peptide Microarray Chip Analysis Representing 61 Proteins from M. tuberculosis", Plos One, Public Library of Science, vol. 3, No. 12, Dec. 1, 2008, pp. e3840-e3841, XP009159747, ISSN:1932-6203.
Canadian Office Action for serial No. 2,679,573, filed Feb. 14, 2008, mailed Jul. 11, 2013, 5 pgs.
Apel, William A.; Non-Final Office Action for U.S. Appl. No. 13/771,915, filed Feb. 20, 2013, mailed Sep. 11, 2013, 11 pgs.
Apel, William A.; Notice of Allowance for U.S. Appl. No. 13/771,915, filed Feb. 20, 2013, mailed Oct. 31, 2014, 15 pgs.
Thompson, Vicki S.; Notice of Allowability for U.S. Appl. No. 12/586,109, filed Sep. 17, 2009, mailed Oct. 30, 2014, 4 pgs.
Lacey, Jeffrey A.; Non-Final Office Action for U.S. Appl. No. 14/209,720, filed Mar. 13, 2014, mailed Mar. 24, 2015, 56 pgs.
Thompson, Vicki S.; Issue Notification for U.S. Appl. No. 12/586,109, filed Sep. 17, 2009, mailed Feb. 11, 2015, 1 pg.
Thompson, Vicki S.; Notice of Allowability for U.S. Appl. No. 12/586,109, filed Sep. 17, 2009, mailed Jan. 28, 2015, 6 pgs.
Thompson, Vicki; European Office Action for serial No. 10819278.2, filed Sep. 17, 2010, mailed Feb. 17, 2014, 5 pgs.
Apel, William A.; Restriction Requirement for U.S. Appl. No. 13/832,406, filed Mar. 15, 2013, mailed Feb. 26, 2014; 7 pgs.
Apel, William; PCT Application entitled: Antibody Profiling, Methods and Apparatus for Identifying an Individual or Source of a Biological Material, having serial No. PCT/US2014/024779, filed Mar. 12, 2014, 49 pgs.
Thompson, Vicki; Final Office Action for U.S. Appl. No. 12/586,109, filed Sep. 17, 2009, mailed Mar. 11, 2014, 17 pgs.
Lacey, Jeffrey; PCT Application entitled: Computing Systems, Computer-Readable Media and Methods of Antibody Profiling, having serial No. PCT/US14/25561, filed Mar. 13, 2014, 57 pgs.
Apel, William A.; Final Office Action for U.S. Appl. No. 13/771,915, filed Feb. 20, 2013, mailed Mar. 19, 2014, 33 pgs.
Lacey, Jeffrey A.; U.S. Patent Application Entitled: Computing Systems, Computer-Readable Media and Methods of Antibody Profiling, U.S. Appl. No. 14/209,720, filed Mar. 13, 2014; 60 pgs.
Thompson, Vicki S.; Non-Final Office Action for U.S. Appl. No. 12/586,109, filed Sep. 17, 2009, mailed Nov. 19, 2013, 32 pgs.
Canadian Office Action for serial No. 2,679,573, filed Feb. 14, 2008, mailed May 16, 2014, 5 pgs.
Apel, William A.; European Office Action for serial No. 08780412.6, filed Feb. 12, 2008, mailed Apr. 4, 2014, 6 pgs.
Apel, William A.; Non-Final Office Action for U.S. Appl. No. 13/832,406, filed Mar. 15, 2013, mailed Jul. 25, 2014, 75 pgs.
Guo, et al.; Functional Protein Microarrays in Drug Discovery 8 (2007) : 53.
Thompson, Vicki S.; Notice of Allowance for U.S. Appl. No. 12/586,109, filed Sep. 17, 2009, mailed Oct. 14, 2014, 16 pgs.
Apel, William; International Search Report and Written Opinion for serial No. PCT/US2014/024779, filed Mar. 12, 2014, mailed Sep. 8, 2014, 27 pgs.
Lacey, Jeffrey A.; International Search Report and Written Opinion for PCT/US2014/025561, filed Mar. 13, 2014, mailed Aug. 7, 2014, 9 pgs.
Espina, et al.; Protein microarrays: molecular profiling technologies for clinical specimens. Proteomics Nov. 2003, vol. 3 No. 11, pp. 2091-2100.
Apel, William A.; Final Office Action for U.S. Appl. No. 13/832,406, filed Mar. 15, 2013, mailed Jun. 11, 2015, 29 pgs.
Thompson, Vicki; European Office Action for serial No. 10819278.2, filed Sep. 17, 2010, mailed May 11, 2015, 3 pgs.
Lebrun, et al.; "Development of an individual-specifc autoantibody (ISA) protein microarray", Biotechnology and Applied Biochemistry, vol. 41, No. 1, (Feb. 1, 2005), pp. 85-88, XP009184126.

* cited by examiner

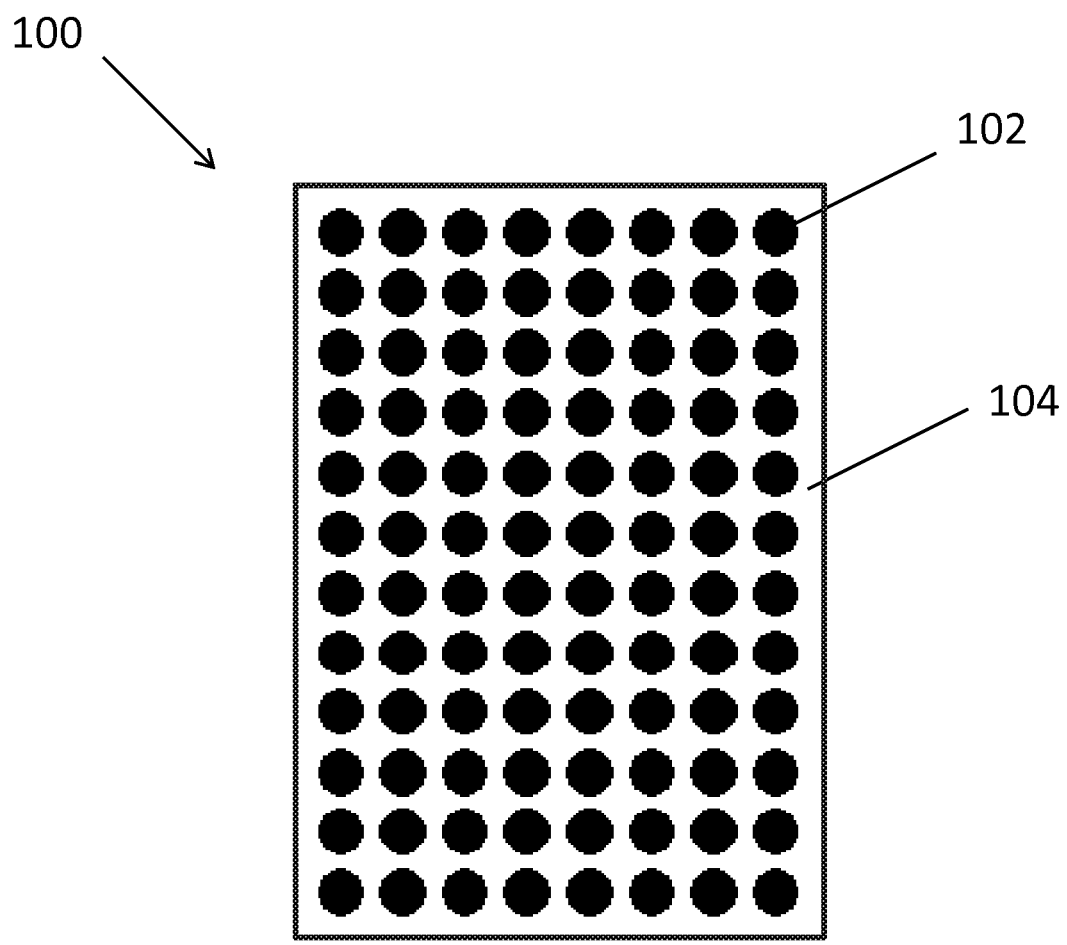

IDENTIFICATION OF DISCRIMINANT PROTEINS THROUGH ANTIBODY PROFILING, METHODS AND APPARATUS FOR IDENTIFYING AN INDIVIDUAL

CROSS-REFERENCE TO RELATED APPLICATION

This application is a continuation-in-part, of U.S. patent application Ser. No. 12/586,109, filed Sep. 17, 2009, now U.S. Pat. No. 8,969,009, issued Mar. 3, 2015, for "IDENTIFICATION OF DISCRIMINANT PROTEINS THROUGH ANTIBODY PROFILING, METHODS AND APPARATUS FOR IDENTIFYING AN INDIVIDUAL," the entirety of the contents of which are incorporated herein by this reference.

GOVERNMENT RIGHTS

This invention was made with government support under Contract Number DE-AC07-05ID14517 awarded by the United States Department of Energy. The government has certain rights in the invention.

STATEMENT REGARDING SEQUENCE LISTING

An electronic version of the Sequence Listing has been submitted concomitant with this application, the contents of which are hereby incorporated by reference. The sequence listing is being submitted as a PDF version and TXT version. The TXT file is identified as "Seq_List_v.1_ST25.txt" which is 722 KB and created on Sep. 15, 2010.

TECHNICAL FIELD

Embodiments of the present invention relate to analyzing biological samples to identify proteins useful in identifying individuals, and more particularly, to methods and apparatus for identifying an individual using such proteins.

BACKGROUND

The importance of differentiating and identifying individuals based on biological samples with a high degree of efficiency and accuracy is presented in various contexts. For example, the need for accurate means of identification is of increasing importance in law enforcement as it may be critical to link an individual to a forensic sample, such as blood, tissue, hair, saliva, or the like.

Many methods are known for identifying individuals or biological samples obtained from such individuals. For example, blood typing is based on the existence of antigens on the surface of red blood cells. The ABO system relates to four different conditions with respect to two antigens, A and B. Type A individuals exhibit the A antigen; Type B individuals exhibit the B antigen; Type AB individuals exhibit both the A and B antigens; and Type O individuals exhibit neither the A nor the B antigen. By analyzing a sample of a person's blood, it is possible to classify the blood as belonging to one of these blood groups. While this method may be used to identify one individual out of a small group of individuals, the method is limited when the group of individuals is larger because no distinction is made between persons of the same blood group. For example, the distribution of the ABO blood groups in the U.S. is approximately 45% O, 42% A, 10% B, and 3% AB. Tests based on other blood group antigens or isozymes present in body fluids suffer from the same disadvantages as the ABO blood typing tests. These methods may exclude certain individuals, but cannot differentiate between members of the same blood group.

A variety of immunological and biochemical tests based on genetics are routinely used in paternity testing, as well as for determining the compatibility of donors and recipients involved in transplant or transfusion procedures, and also sometimes as an aid in the identification of humans and animals. For example, serological testing of proteins encoded by the human leukocyte antigen (HLA) gene locus is well known. Although a good deal of information is known concerning the genetic makeup of the HLA locus, there are many drawbacks to using HLA serological typing for identifying individuals in a large group. Each of the HLA antigens must be tested for in a separate assay, and many such antigens must be assayed to identify an individual, an arduous process when identifying one individual in a large group.

In the past decade, DNA-based analysis methods, such as restriction fragment length polymorphisms (RFLPs) and polymerase chain reaction (PCR) have rapidly gained acceptance in forensic and paternity analyses for matching biological samples to an individual. RFLP techniques are problematic, however, due to the need for relatively large sample sizes, specialized equipment, highly skilled technicians, and lengthy analysis times. For forensic applications there is often not enough sample available for this type of assay, and in remote areas the necessary equipment is often not available. In addition, the cost and length of time required to performed this technique may hinder a criminal investigation. Moreover, the cost of RFLP analysis may be prohibitory if screening of many samples is necessary. PCR techniques have the advantages over RFLP analysis of requiring much smaller sample sizes and permitting more rapid analysis, but they still require specialized equipment and skilled technicians, and they are also expensive.

Antibody profiling is an identification technique that has many advantages over conventional DNA-based analysis methods. For example, antibody profiling methods provide increased speed and ease of use and decreased costs in comparison to conventional DNA based analysis. Current antibody profiling methods for identifying individuals utilize an undefined mixture of proteins.

U.S. Pat. No. 4,880,750 and U.S. Pat. No. 5,270,167 each disclose antibody profiling as a method that purportedly overcomes many of the disadvantages associated with DNA analysis. The antibody profiling method is based on the discovery that every individual has a unique set of antibodies present in his or her bodily fluids. R. M. Bernstein et al., *Cellular Protein and RNA Antigens in Autoimmune Disease*, 2 Mol. Biol. Med. 105-120 (1984). Such antibodies, termed "individual-specific antibodies" or "ISAs," were found in blood, serum, saliva, urine, semen, perspiration, tears, and body tissues. A. M. Francoeur, *Antibody Fingerprinting: A Novel Method for Identifying Individual People and Animals,* 6 Bio/technology 821-825 (1988). The ISAs are not associated with disease and are thought to be directed against cellular components of the body. Individuals are born with an antibody profile that matches the mother's antibody profile. T. F. Unger & A. Strauss, *Individual-specific Antibody Profiles as a Means of Newborn Infant Identification,* 15 J. Perinatology 152-155 (1995). An individual's antibody profile gradually changes, however, until a stable unique pattern is obtained by about two years of age. It has been shown that even genetically identical individuals have different antibody profiles. An individual's profile is apparently stable for life and is not affected by short-term illnesses. A. M. Francoeur, supra. Few studies have been conducted on individuals with long-term diseases. Preliminary results, however, indicate that, although a few extra bands may appear, the overall pattern remains intact. This technique has been used in the medical field to track patient samples and avoid sample mix-ups. In addition, the technique has been used in hospitals in cases where switching of infants or abduction has been alleged.

WO 97/29206 discloses a method for identifying the source of a biological sample used for diagnostic testing by linking diagnostic test results to an antibody profile of the biological sample. By generating an antibody profile of each biological sample, the origin of the biological sample is identified.

Assays are also available that use specific nucleic acid probes or other biological molecules attached to surfaces such as glass, silicon, polymethacrylate, polymeric filters, microspheres, resins, and the like. In a configuration where the surface is planar, these assays are sometimes referred to as "biochips." Initially, biochips contained nucleic acid probes attached to glass or silicon substrates in microarrays. These DNA or RNA chips are made by microfabrication technologies initially developed for use in computer chip manufacturing. Leading DNA chip technologies include an in situ photochemical synthesis approach, P. S. Fodor, 277 Science 393-395 (1997); U.S. Pat. No. 5,445,934; an electrochemical positioning approach, U.S. Pat. No. 5,605,662; depositing gene probes on the chip using a sprayer that resembles an ink-jet printer; and the use of gels in a solution-based process. Arrays of other types of molecules, such as peptides, have been fabricated on biochips, e.g., U.S. Pat. No. 5,445,934.

BRIEF SUMMARY

In some embodiments, the present invention includes a method of determining discriminant proteins useful for identifying an individual. For example, the method may be used to determine a set that includes one or more of such discriminant proteins. A plurality of samples may be obtained from a different individual and may include individual specific antibodies. Each of the plurality of samples may be contacted with an array including a plurality of antigens to form at least one immune complex, the immune complex including an individual specific antibody from the sample bound to an antigen of the array. Each antigen of the array is known and is immobilized at a known predetermined location in the array. At least one detection agent may be applied to the array and may include at least one interacting protein conjugated to a marker to detect the immune complexes. The immune complexes on the array may be detected to obtain an antibody profile corresponding to each of the different individuals and the antibody profiles corresponding to the different individuals may be compared using, for example, discriminant analysis, to determine at least one target antigen as a discriminant protein useful for indentifying an individual from at least one other individual or population of individuals.

In additional embodiments, the present invention includes a method for identifying source of a biological material. Less than about 200 antigens may be immobilized on a support to form an array. A sample of a biological material including individual-specific antibodies may be obtained and contacted with the array to bind at least a portion of the individual-specific antibodies to the multiple antigens of the array forming immune complexes. A blocking step may be performed prior to applying the sample to prevent binding of antigens, antibodies, and the like to the support wherein such antigens, antibodies, or other molecules are not intended to bind. Any unbound antigens may then be removed. A detection system such as those disclosed in U.S. Patent Application Nos. 2007/0190585 and 2008/0298667, may be used to detect the immune complexes. For example, at least one detection agent including at least one interacting protein conjugated to a marker may be applied to the array to detect the immune complexes. The support may then be washed to remove non-immobilized individual-specific antibodies and detection agent. The immune complexes on the array may be detected to obtain an antibody profile and the antibody profile may be compared to a known antibody profile obtained from an individual. For example, the antibody profile may be correlated to a single individual in a population of from about 1 million individuals to about 100 billion individuals.

In yet further embodiments, the present invention includes a method of designing a protein array useful in identifying an individual. A plurality of samples may be introduced to an array comprising a plurality of antigens, wherein each of the antigens is known and wherein each of the antigens is immobilized at a known predetermined location on a support. Each of the antigens may be known and may be immobilized at a known predetermined location on a support. At least one detection agent including at least one interacting protein conjugated to a marker may be applied to the array to detect immune complexes formed between individual-specific antibodies and antigens of the plurality. The immune complexes formed on the array may be detected to obtain an antibody profile for each of the plurality of samples. The antibody profiles may be analyzed to determine a set of antigens useful in distinguishing an individual among a population.

In still further embodiments, the present invention includes a method of determining a relationship between a plurality of individuals. An array including less than about 100 antigens, less than about 110 antigens, less than about 170 antigens, or less than about 200 antigens on a support may be formed. Each of the antigens is determined to distinguish between individuals. A sample of a biological material having individual-specific antibodies may be obtained from each of a plurality of individuals. The array may be contacted with the sample to bind at least a portion of the individual-specific antibodies therein to the multiple antigens of the array, to form at least one immune complex. At least one detection agent including at least one interacting protein conjugated to a marker may be applied to the array to detect the immune complexes. Non-immobilized individual-specific antibodies may then be removed and the at least one detection agent of the immune complexes on the array may be detected to obtain an antibody profile.

BRIEF DESCRIPTION OF THE DRAWING

While the specification concludes with claims particularly pointing out and distinctly claiming that which is regarded as the present invention, advantages of this invention may be more readily ascertained from the following description of the invention when read in conjunction with the accompanying drawing in which:

FIG. 1 is an illustration of a protein array according to an embodiment of the invention.

DETAILED DESCRIPTION

Before embodiments of the present invention are described in detail, it is to be understood that this invention is not limited to the particular configurations, process acts, and materials disclosed herein as such configurations, process acts, and materials may vary somewhat. It is also to be understood that the terminology employed herein is used for the purpose of describing particular embodiments only and is not limiting since the scope of the present invention will be limited only by the appended claims and equivalents thereof.

The publications and other reference materials referred to herein to describe the background of the invention and to provide additional detail regarding its practice. The references discussed herein are provided solely for their disclosure prior to the filing date of the present application. Nothing herein is to be construed as an admission that such documents constitute prior art, or that the inventors are not entitled to antedate such disclosure by virtue of prior invention.

While the known methods for using antibody profiling are generally suitable for their limited purposes, they possess certain inherent deficiencies that detract from their overall utility in analyzing, characterizing, and identifying biological samples. For example, the known methods rely on fractionation of antigens by electrophoresis and then transfer of the fractionated antigens to a membrane. Due to differences in conditions from one fractionation procedure to another, there are lot-to-lot differences in the positions of the antigens on the membrane such that results obtained using membranes from one lot cannot be compared with results obtained using membranes from another lot. Further, when colorimetric procedures are used for detecting immune complexes on the membrane, color determination may be subjective such that results may be interpreted differently by different observers.

It would be advantageous to provide a method identifying proteins capable of distinguishing an individual and methods for efficiently and accurately determining identity, distinguishing between individuals, as well as determining the source of biological fluids, especially those amenable to automation.

It must be noted that, as used in this specification and the appended claims, the singular forms "a," "an," and "the" include plural referents unless the context clearly dictates otherwise. Thus, for example, reference to a method for analyzing a biological sample from "an animal" includes reference to two or more of such animals, reference to "a support" includes reference to one or more of such supports, and reference to "an array" includes reference to two or more of such arrays.

As used herein, "blood" means and includes whole blood, plasma, serum, or any derivative of blood. A blood sample may be, for example, serum.

As used herein, "comprising," "including," "containing," "characterized by," and grammatical equivalents thereof are inclusive or open-ended terms that do not exclude additional, unrecited elements or method acts. "Comprising" is to be interpreted as including the more restrictive terms "consisting of" and "consisting essentially of."

As used herein, "consisting of" and grammatical equivalents thereof exclude any element, step, or ingredient not specified in the claim.

As used herein, "consisting essentially of" and grammatical equivalents thereof limit the scope of a claim to the specified materials or acts and those that do not materially affect the basic and novel characteristic or characteristics of the claimed invention.

As used herein, the terms "biological sample" and "sample" mean and include a sample comprising individual-specific antibodies obtained from an organism or from components (e.g., cells) of an organism. The sample may be of any biological material. Such samples include, but are not limited to, blood, blood fractions (e.g., serum, plasma), blood cells (e.g., white cells), tissue or fine needle biopsy samples, urine, saliva, perspiration or semen. Biological samples may also include sections of tissues such as frozen sections taken for histological purposes.

As used herein, "colorigenic" refers to a substrate that produces a colored product upon digestion with an appropriate enzyme. Such colored products include fluorescent and luminescent products.

The term "discriminant analysis" means and includes a set of statistical methods used to select features that optimally discriminate between two or more groups. Application of discriminant analysis to a data set allows the user to focus on the most discriminating features for further analysis.

As used herein, the terms "immobilized" or "affixed" mean and include an association between a protein or antigen and a substrate at the molecular level (i.e., through a covalent or non-covalent bond or interaction). For example, a protein may be immobilized to a support by covalent bonding directly to a surface of the support, which may or may not be modified to enhance such covalent bonding. Also, the protein may be immobilized to the support by use of a linker molecule between the protein and the support. Proteins may further be immobilized on the support by steric hindrance within a polymerized gel or by covalent bonding within a polymerized gel. Proteins may also be immobilized on a support through hybridization between the protein and a molecule immobilized on the support.

The term "protein array" as used herein refers to a protein array, a protein macroarray, a protein microarray or a protein nanoarray. A protein array may include, for example, but is not limited to, a PROTOARRAY® high density protein array, which is commercially available from Invitrogen (Carlsbad, Calif.). The PROTOARRAY® high density protein array may be used to screen complex biological mixtures, such as serum, to assay for the presence of autoantibodies directed against human proteins. Alternatively, a custom protein array that includes autoantigens, such as those provided herein, for the detection of autoantibody biomarkers, may be used to assay for the presence of autoantibodies directed against human proteins. In certain disease states including autoimmune diseases and cancer, autoantibodies are expressed at altered levels relative to those observed in healthy individuals.

As used herein, "support" means a generally or substantially planar substrate onto which an array of antigens is disposed. A support may comprise any material or combination of materials suitable for carrying the array. Materials used to construct these supports need to meet several requirements, such as (1) the presence of surface groups that may be easily derivatized, (2) inertness to reagents used in the assay, (3) stability over time, and (4) compatibility with biological samples. For example, suitable materials include glass, silicon, silicon dioxide (i.e., silica), plastics, polymers, hydrophilic inorganic supports, and ceramic materials. Illustrative plastics and polymers include poly(tetrafluoroethylene), poly (vinylidenedifluoride), polystyrene, polycarbonate, polymethacrylate, and combinations thereof. Illustrative hydrophilic inorganic supports include alumina, zirconia, titania, and nickel oxide. An example of a glass substrate would be a microscope slide. Silicon wafers used to make computer chips have also been used to make biochips. See, for example, U.S. Pat. No. 5,605,662. The supports may further include a coating, such as, nitrocellulose, gelatin, a polymer (i.e., polyvinyl difluoride) or an aldehyde.

In some embodiments, a method of determining proteins useful in discriminating one individual from one or more other individuals and/or positively identifying an individual is provided. Such proteins may be referred to herein as "discriminant proteins." The method may employ a protein array including a plurality of proteins immobilized on a support. As a non-limiting example, the protein array may be a PROTOARRAY® human protein microarray, which is commercially available from Invitrogen Corporation (Carlsbad, Calif.). The plurality of proteins immobilized on the support may include a plurality of antigens.

In a typical assay, a plurality of biological samples including individual-specific antibodies may each be physically contacted with a protein array, under conditions that permit high affinity binding, but that minimize non-specific interactions. In one embodiment, the biological samples are introduced to the protein array that includes a plurality of antigens immobilized in predetermined locations on a support. The protein array may be washed free of unbound material, and the presence of bound antibodies may be detected, and correlated with the cognate antigen.

The data collected from each of the plurality of biological samples profiled on a protein array may be used to determine an antibody profile for the individual. The antibody profiles may be analyzed using, for example, conventional discriminant analysis methods, to determine proteins relevant in discriminating and positively identifying an individual (i.e., discriminant proteins) from a population of one or more other individuals. The discriminant proteins may be used to generate a test panel for identifying an individual or determining a source of a biological sample. In some embodiments, the test panel may be, for example, a protein array 100, as shown in FIG. 1, including a plurality of the discriminant proteins arranged as spots 102 in predetermined locations on a support 104.

Protein Array

The protein array may be prepared by attaching the antigens to the surface of the support in a preselected pattern such that the locations of antigens in the array are known. As used herein, an antigen is a substance that is bound by an antibody. Antigens may include proteins, carbohydrates, nucleic acids, hormones, drugs, receptors, tumor markers, and the like, and mixtures thereof. An antigen may also be a group of antigens, such as a particular fraction of proteins eluted from a size exclusion chromatography column. Still further, an antigen may also be identified as a designated clone from an expression library or a random epitope library.

In one embodiment, antigens may be isolated from HeLa cells as generally described in A. M. Francoeur et al., *Identcation of Ki (Ku, p70/p80) Autoantigens and Analysis of Anti-Ki Autoantibody Reactivity*, 136 J. Immunol. 1648 (1986). Briefly, HeLa cells may be grown in standard medium under standard tissue culture conditions. Confluent HeLa cell cultures may then be rinsed, preferably with phosphate-buffered saline (PBS), lysed with detergent, and centrifuged to remove insoluble cellular debris. The supernate contains approximately 10,000 immunologically distinct antigens suitable for generating an array.

There is no requirement that the antigens used to generate the array be known. All that is required is that the source of the antigens be consistent such that a reproducible array may be generated. For example, the HeLa cell supernate containing the antigens may be fractionated on a size exclusion column, electrophoretic gel, density gradient, or the like, as is well known in the art. Fractions may be collected, and each fraction collected could represent a unique set of antigens for the purpose of generating the array. Thus, even though the antigens may be unknown, a reproducible array may be generated if the HeLa cell antigens may be isolated and fractionated using the same method and conditions.

Other methods, such as preparation of random peptide libraries or epitope libraries are well known in the art and may be used to reproducibly produce antigens (e.g., J. K. Scott and G. P. Smith, *Searching for Peptide Ligands with an Epitope Library*, 249 Science 386 (1990); J. J. Devlin et al., *Random Peptide Libraries: A Source of Specific Protein Binding Molecules*, 249 Science 404-406 (1990); S. E. Cwirla et al., *Peptides on Phage: A Vast Library of Peptides for Identifying Ligands*, 87 Proc. Nat'l Acad. Sci. USA 6378-6382 (1990); K. S. Lam et al., *A New Type of Synthetic Peptide Library for Identifying Ligand-binding Activity*, 354 Nature 82-84 (1991); S. Cabilly, *Combinatorial Peptide Library Protocols*, Humana Press, 304 pp., 129-154 1997; and U.S. Pat. No. 5,885,780). Such libraries may be constructed by ligating synthetic oligonucleotides into an appropriate fusion phage. Fusion phages may be filamentous bacteriophage vectors in which foreign sequences may be cloned into phage gene III and displayed as part of the gene III protein (pIII) at one tip of the virion. Each phage encodes a single random sequence and expresses it as a fusion complex with pIII, a minor coat protein present at about five molecules per phage. For example, in the fusion phage techniques of J. K. Scott and G. P. Smith, supra, a library was constructed of phage containing a variable cassette of six amino acid residues. The hexapeptide modules fused to bacteriophage proteins provided a library for the screening methodology that may examine $>10^{12}$ phages (or about $10^8$-$10^{10}$ different clones) at one time, each with a test sequence on the virion surface. The library obtained was used to screen monoclonal antibodies specific for particular hexapeptide sequences. The fusion phage system has also been used by other groups, and libraries containing longer peptide inserts have been constructed. Fusion phage prepared according to this methodology may be selected randomly or non-randomly for inclusion in the array of antigens. The fusion phages selected for inclusion in the array may be propagated by standard methods to result in what is virtually an endless supply of the selected antigens.

Other methods for producing antigens are also known in the art. For example, expression libraries may be prepared by random cloning of DNA fragments or cDNA into an expression vector (e.g., R. A. Young and R. W. Davis, *Yeast RNA Polymerase II Genes: Isolation with Antibody Probes*, 222 Science 778-782 (1983); G. M. Santangelo et al., *Cloning of Open Reading Frames and Promoters from the Saccharomyces cerevisiae Genome: Construction of Genomic Libraries of Random Small Fragments*, 46 Gene 181-186 (1986). Expression vectors that could be used for making such libraries are commercially available from a variety of sources. For example, random fragments of HeLa cell DNA or cDNA may be cloned into an expression vector, and then clones expressing HeLa cell proteins may be selected. These clones may then be propagated by methods well known in the art. The expressed proteins may then be isolated or purified and may be used in the making of the array.

Alternatively, antigens may be synthesized using recombinant DNA technology well known in the art. Genes that code for many proteins from a gamut of organisms including viruses, bacteria, and mammals have been cloned, and thus large quantities of highly pure proteins may be synthesized quickly and inexpensively. For example, the genes that code for many eukaryotic and mammalian membrane-bound receptors, growth factors, cell adhesion molecules, and regulatory proteins have been cloned and may be useful as antigens. Many proteins produced by such recombinant techniques, such as transforming growth factor, acidic and basic fibroblast growth factors, interferon, insulin-like growth factor, and various interleukins from different species, are commercially available. In most instances, the entire polypeptide need not be used as an antigen. For example, any size or portion of the polypeptide that contains at least one epitope, i.e., antigenic determinant or portion of an antigen that specifically interacts with an antibody, will suffice for use in the array. In addition, a particular antigen may be purified or isolated from any natural or synthetic source of the antigen by methods known in the art.

The antigens, whether selected randomly or non-randomly, may be disposed on the support to result in the array. The pattern of the antigens on the support should be reproducible. In embodiments, the location and identity of each antigen on the support may be known. For example, in a 10×10 array one skilled in the art might place antigens 1-100 in locations 1-100, respectively, of the array. As a non-limiting example, each of the antigens of the array may be deposited on the support as a spot having a diameter of from about 10 microns to about 500 microns and, more particularly, from about 50 microns to about 300 microns.

The proteins may be placed in arrays on the surface of the support using a pipetting device or a machine or device configured for placing liquid samples on a support, for example, using a commercially available microarrayer, such as those from Arrayit Corporation (Sunnyvale, Calif.); Genomic Solutions, Inc. (Ann Arbor, Mich.); Gene Machines (San Carlos, Calif.); Genetic MicroSystems, Inc. (Woburn, Mass.); GenePack DNA (Cambridge, UK); Genetix Ltd. (Christchurch, Dorset, UK); and Packard Instrument Company (Meriden, Conn.).

Relevant methods to array a series of proteins onto a surface include contact printing processes, non-contact printing processes and in silico protein synthesis arrayer processes. Commercially available instruments are available for both methods. In some embodiments, conventional contact printing processes, such as contact pin printing and microstamping, in which the printing device may physically contact a surface may be used to apply the proteins to the surface of a support. For example, a pin printing device such as that commercially available from Arrayit Corporation may be used to deposit spots having an average diameter of 65 microns or larger. As another non-limiting example, Genomic Solutions offers several nanoliter dispensing instruments that may dispense liquid volumes from 20 mL up to 250 µL from 96-, 384-, 1536-, 3456-, and 9600-well microtiter plates and place them precisely on a surface with densities up to 400 spots/$cm^2$. The instruments will spot onto surfaces in a variety of patterns. In additional embodiments, the protein antigens may be applied to the surface without physical contact between the printing device and the surface using conventional non-contact printing processes including, but not limited to, photochemistry-based methods, laser writing, electrospray deposition, and inkjet. As the name implies, inkjet technology utilizes the same principles as those used in inkjet printers. MicroFab Technologies, Inc. (Plano, Tex.), offers a ten-fluid print head that may dispense picoliter quantities of liquids onto a surface in a variety of patterns. An illustrative pattern for the present application would be a simple array ranging from 10×10 up to 100×100. The protein antigens may be applied to the surface using a serial deposition process or a parallel deposition process.

There are a number of methods that may be used to attach proteins or other antigens to the surface of a support. The simplest of these is simple adsorption through hydrophobic, ionic, and van der Waals forces. As a non-limiting example, bifunctional organosilanes may be used in attachment of proteins to the surface of the support (e.g., Thompson and Maragos, *Fiber-Optic Immunosensor for the Detection of Fumonisin* $B_1$, 44 J. Agric. Food Chem. 1041-1046 (1996)). One end of the organosilane reacts with exposed —OH groups on the surface of the support to form a silanol bond. The other end of the organosilane contains a group that is reactive with various groups on the protein surface, such as —$NH_2$ and —SH groups. This method of attaching proteins to the support results in the formation of a covalent linkage between the protein and the support. Other suitable methods that have been used for protein attachment to surfaces include arylazide, nitrobenzyl, and diazirine photochemistry methodologies. Exposure of the above chemicals to UV light causes the formation of reactive groups that may react with proteins to form a covalent bond. The arylazide chemistry forms a reactive nitrene group that may insert into C—H bonds, while the diazirine chemistry results in a reactive carbene group. The nitrobenzyl chemistry is referred to as caging chemistry whereby the caging group inactivates a reactive molecule. Exposure to UV light frees the molecule and makes it available for reaction. Still other methods for attaching proteins to supports are well known in the art, (e.g., S. S. Wong, *Chemistry of Protein Conjugation and Cross-Linking* CRC Press, 340, 1991).

Following attachment of the antigens on the support in the selected array, the support may be washed. The wash solution may include, for example, one or more of a surfactant or a non-specific protein such as bovine serum albumin (BSA). Appropriate liquids for washing include, but are not limited to, phosphate buffered saline (PBS) and the like, i.e., relatively low ionic strength, biocompatible salt solutions buffered at or near neutrality. Many of such appropriate wash liquids are known in the art or may be devised by a person skilled in the art without undue experimentation (e.g., N. E. Good and S. Izawa, *Hydrogen Ion Buffers,* 24 Methods Enzymology 53-68 (1972)).

The support may be processed for blocking of nonspecific binding of proteins and other molecules to the support. This blocking step may prevent the binding of antigens, antibodies, and the like to the support wherein such antigens, antibodies, or other molecules are not intended to bind. Blocking may reduce the background that might swamp out the signal, thus increasing the signal-to-noise ratio. The support may be blocked by incubating the support in a medium that contains inert molecules that bind to sites where nonspecific binding might otherwise occur. Examples of suitable blockers include, but are not limited to, bovine serum albumin, human albumin, gelatin, nonfat dry milk, polyvinyl alcohol, TWEEN® 20, and various commercial blocking buffers, such as SEABLOCK™ blocking buffer from EastCoast Bio, Inc., (West Berwick, Me.) and SUPERBLOCK® blocking buffer from Pierce Chemical Co., (Rockford, Ill.). In some embodiments, one or more of the suitable blockers may be incorporated into the wash solution described above.

Antibody Profile

The array may be contacted with a sample of the biological material to be tested. For example, the biological sample may be obtained from various bodily fluids and solids, including blood, saliva, semen, serum, plasma, urine, amniotic fluid, pleural fluid, cerebrospinal fluid, and mixtures thereof. These samples may be obtained according to methods well known in the art. Depending on the detection method used, it may be required to manipulate the biological sample to attain optimal reaction conditions. For example, the ionic strength or hydrogen ion concentration or the concentration of the biological sample may be adjusted for optimal immune complex formation, enzymatic catalysis, and the like.

As described in detail in U.S. Pat. No. 5,270,167 to Francoeur, when ISAs are allowed to react with a set of random antigens, a certain number of immune complexes form. For example, using a panel of about 1000 unique antigens, about 30 immune complexes between ISAs in a biological sample that has been diluted 20-fold may be detected. If the biological sample is undiluted, the total number of possible detectable immune complexes that could form would be greater than $10^{23}$. The total number of possible immune complexes may also be increased by selecting "larger" antigens, i.e., proteins instead of peptides) that have multiple epitopes. Therefore, it will be appreciated that depending on the antigens and number thereof used, the dilution of the biological sample, and the detection method, one skilled in the art may regulate the number of immune complexes that will form and be detected. As used herein, an "antibody profile" refers to the set of unique immune complexes that form and fail to form between the ISAs in the biological sample and the antigens in the array.

Detection and/or Quantification of Reactions

Methods for detecting antibody/antigen or immune complexes are well known in the art. The present invention may be modified by one skilled in the art to accommodate the various detection methods known in the art. The particular detection method chosen by one skilled in the art depends on several factors, including the amount of biological sample available, the type of biological sample, the stability of the biological sample, the stability of the antigen, and the affinity between the antibody and antigen. Moreover, as discussed above, depending on the detection methods chosen, it may be required to modify the biological sample. While these techniques are well known in the art, non-limiting examples of a few of the detection methods that may be used to practice the present invention are briefly described below.

There are many types of immunoassays known in the art. The most common types of immunoassay are competitive and non-competitive heterogeneous assays, such as, for example, enzyme-linked immunosorbent assays (ELISAs). In a non-competitive ELISA, unlabeled antigen is bound to a support. A biological sample may be combined with antigens bound to the reaction vessel, and antibodies (primary antibodies) in the biological sample may be allowed to bind to the antigens, forming the immune complexes. After the immune complexes have formed, excess biological sample may be removed and the array may be washed to remove nonspecifically bound antibodies. The immune complexes may then be reacted with an appropriate enzyme-labeled anti-immunoglobulin (secondary antibody). The secondary antibody reacts with antibodies in the immune complexes, not with other antigens bound to the array. Secondary antibodies specific for binding antibodies of different species, including humans, are well known in the art and are commercially available, such as from Sigma Chemical Co. (St. Louis, Mo.) and Santa Cruz Biotechnology, Inc. (Santa Cruz, Calif.). After an optional further wash, the enzyme substrate may be added. The enzyme linked to the secondary antibody catalyzes a reaction that converts the substrate into a product. When excess antigen is present, the amount of product is directly proportional to the amount of primary antibody present in the biological sample. By way of non-limiting example, the product may be fluorescent or luminescent, which may be measured using technology and equipment well known in the art. It is also possible to use reaction schemes that result in a colored product, which may be measured spectrophotometrically.

In other embodiments of the invention, the secondary antibody may not be labeled to facilitate detection. Additional antibodies may be layered (i.e., tertiary, quaternary, etc.) such that each additional antibody specifically recognizes the antibody previously added to the immune complex. Any one of these additional (i.e., tertiary, quaternary, etc.) may be labeled so as to allow detection of the immune complex as described herein.

Sandwich or capture assays may also be used to identify and quantify immune complexes. Sandwich assays are a mirror image of non-competitive ELISAs in that antibodies are bound to the solid phase and antigen in the biological sample is measured. These assays may be particularly useful in detecting antigens having multiple epitopes that are present at low concentrations. This technique requires excess antibody to be attached to a solid phase. The bound antibody is then incubated with the biological samples, and the antigens in the sample may be allowed to form immune complexes with the bound antibody. The immune complex is incubated with an enzyme-linked secondary antibody, which recognizes the same or a different epitope on the antigen as the primary antibody. Hence, enzyme activity is directly proportional to the amount of antigen in the biological sample. D. M. Kemeny and S. J. Challacombe, *ELISA and Other Solid Phase Immunoassays*, (John Wiley & Sons Ltd.) (1988).

Typical enzymes that may be linked to secondary antibodies include, but are not limited to, horseradish peroxidase, glucose oxidase, glucose-6-phosphate dehydrogenase, alkaline phosphatase, β-galactosidase, and urease. Secondary antigen-specific antibodies linked to various enzymes are commercially available from, for example, Sigma Chemical Co. and Amersham Life Sciences (Arlington Heights, Ill.).

Competitive ELISAs are similar to noncompetitive ELISAs except that enzyme linked antibodies compete with unlabeled antibodies in the biological sample for limited antigen binding sites. Briefly, a limited number of antigens may be bound to the support. Biological sample and enzyme-labeled antibodies may be added to the support. Antigen-specific antibodies in the biological sample compete with enzyme-labeled antibodies for the limited number of antigens bound to the support. After immune complexes have formed, nonspecifically bound antibodies may be removed by washing, enzyme substrate is added, and the enzyme activity is measured. No secondary antibody is required. Because the assay is competitive, enzyme activity is inversely proportional to the amount of antibodies in the biological sample.

Another competitive ELISA may also be used within the scope of the present invention. In this embodiment, limited amounts of antibodies from the biological sample may be bound to the surface of the support as described herein. Labeled and unlabeled antigens may be then brought into contact with the support such that the labeled and unlabeled antigens compete with each other for binding to the antibodies on the surface of the support. After immune complexes have formed, nonspecifically bound antigens may be removed by washing. The immune complexes may be detected by incubation with an enzyme-linked secondary antibody, which recognizes the same or a different epitope on the antigen as the primary antibody, as described above. The activity of the enzyme is then assayed, which yields a signal that is inversely proportional to the amount of antigen present.

Homogeneous immunoassays may also be used when practicing the method of the present invention. Homogeneous immunoassays may be preferred for detection of low molecular weight compounds, such as hormones, therapeutic drugs, and illegal drugs that cannot be analyzed by other methods, or compounds found in high concentration. Homogeneous assays may be particularly useful because no separation step is necessary. R. C. Boguslaski et al., *Clinical Immunochemistry: Principles of Methods and Applications*, (1984).

In homogeneous techniques, bound or unbound antigens may be enzyme-linked. When antibodies in the biological sample bind to the enzyme-linked antigen, steric hindrances inactivate the enzyme. This results in a measurable loss in enzyme activity. Free antigens (i.e., not enzyme-linked) compete with the enzyme-linked antigen for limited antibody binding sites. Thus, enzyme activity is directly proportional to the concentration of antigen in the biological sample.

Enzymes useful in homogeneous immunoassays include, but are not limited to, lysozyme, neuraminidase, trypsin, papain, bromelain, glucose-6-phosphate dehydrogenase, and β-galactosidase. T. Persoon, "Immunochemical Assays in the Clinical Laboratory," 5 Clinical Laboratory Science 31 (1992). Enzyme-linked antigens are commercially available or may be linked using various chemicals well known in the art, including glutaraldehyde and maleimide derivatives.

Prior antibody profiling technology involved an alkaline phosphatase labeled secondary antibody with 5-bromo-4-chloro-3'-indolylphosphate p-toluidine salt (BCIP) and nitroblue tetrazolium chloride (NBT), both of which are commercially available from a variety of sources, such as from Pierce Chemical Co. (Rockford, Ill.). The enzymatic reaction forms an insoluble colored product that is deposited on the surface of membrane strips to form bands wherever antigen-antibody complexes occur. As a non-limiting example, the array may be scanned to detect a colored product using one of a variety of conventional desktop scanners, which are commercially available from a variety of sources, such as from Canon U.S.A. (Lake Success, N.Y.). The intensity of the colored product may be quantified by calculating the median feature pixel intensity minus median background pixel intensity.

As another non-limiting example, gold nanoparticle labeled antibodies may be employed and may be detected using a scanning, transmission electron microscopy, and/or dark-field zoom stereomicroscopy. Compared to conventional fluorescent labels, the gold nanoparticles scatter incident white light to generate monochromatic light which may be easily detected. The light intensity generated by the gold nanoparticles may be up to 100,000 times greater than that generated by fluorescent-labeled molecules. For example, the gold nanoparticles may be detected using a conventional desktop scanner. Han et al., *Detection of Analyte Binding to Microarrays Using Gold Nanoparticle Labels and a Desktop Scanner*, 3 Lab Chip 329; 329-332 (2003).

Fluorescent immunoassays may also be used when practicing the method of the present invention. Fluorescent immunoassays are similar to ELISAs except the enzyme is substituted for fluorescent compounds called fluorophores or fluorochromes. These compounds have the ability to absorb energy from incident light and emit the energy as light of a longer wavelength and lower energy. Fluorescein and rhodamine, usually in the form of isothiocyanates that may be readily coupled to antigens and antibodies, are most commonly used in the art. D. P. Stites et al., *Basic and Clinical Immunology*, (1994). Fluorescein absorbs light of 490 to 495 nm in wavelength and emits light at 520 nm in wavelength. Tetramethylrhodamine absorbs light of 550 nm in wavelength and emits light at 580 nm in wavelength. Illustrative fluorescence-based detection methods include ELF-97 alkaline phosphatase substrate (Molecular Probes, Inc., Eugene, Oreg.); PBXL-1 and PBXL-3 (phycobilisomes conjugated to streptavidin) (Martek Biosciences Corp., Columbia, Md.); FITC (fluorescein isothiocyanate) and Texas Red labeled goat anti-human IgG (Jackson ImmunoResearch Laboratories, Inc., West Grove, Pa.); and B-Phycoerythrin and R-Phycoerythrin conjugated to streptavidin (Molecular Probes, Inc.). ELF-97 is a nonfluorescent chemical that is digested by alkaline phosphatase to form a fluorescent molecule. Because of turnover of the alkaline phosphatase, use of the ELF-97 substrate results in signal amplification. Fluorescent molecules attached to secondary antibodies do not exhibit this amplification.

Phycobiliproteins isolated from algae, porphyrins, and chlorophylls, which all fluoresce at about 600 nm, are also being used in the art. I. Hemmila, *Fluoroimmunoassays and Immunofluorometric Assays*, 31 Clin. Chem. 359 (1985); U.S. Pat. No. 4,542,104. Phycobiliproteins and derivatives thereof are commercially available under the names R-phycoerythrin (PE) and QUANTUM RED™ from Sigma Chemical Co.

In addition, Cy-conjugated secondary antibodies and antigens may be useful in immunoassays and are commercially available. Cy3, for example, is maximally excited at 554 nm and emits light at between 568 and 574 nm. Cy3 is more hydrophilic than other fluorophores and thus has less of a tendency to bind nonspecifically or aggregate. Cy-conjugated compounds are commercially available from Amersham Life Sciences.

Illustrative luminescence-based detection methods include CSPD® and CDP star alkaline phosphatase substrates from Roche Molecular Biochemicals, (Indianapolis, Ind.) and SUPERSIGNAL® horseradish peroxidase substrate from Pierce Chemical Co., (Rockford, Ill.).

Chemiluminescence, electroluminescence, and electrochemiluminescence (ECL) detection methods may also be attractive means for quantifying antigens and antibodies in a biological sample. Luminescent compounds have the ability to absorb energy, which is released in the form of visible light upon excitation. In chemiluminescence, the excitation source is a chemical reaction; in electroluminescence the excitation source is an electric field; and in ECL an electric field induces a luminescent chemical reaction.

Molecules used with ECL detection methods generally comprise an organic ligand and a transition metal. The organic ligand forms a chelate with one or more transition metal atoms forming an organometallic complex. Various organometallic and transition metal-organic ligand complexes have been used as ECL labels for detecting and quantifying analytes in biological samples. Due to their thermal, chemical, and photochemical stability, their intense emissions and long emission lifetimes, ruthenium, osmium, rhenium, iridium, and rhodium transition metals are favored in the art. The types of organic ligands are numerous and include anthracene and polypyridyl molecules and heterocyclic organic compounds. For example, bipyridyl, bipyrazyl, terpyridyl, and phenanthrolyl, and derivatives thereof, are common organic ligands in the art. A common organometallic complex used in the art includes tris-bipyridine ruthenium (II), commercially available from IGEN, Inc. (Rockville, Md.) and Sigma Chemical Co.

ECL may be performed under aqueous conditions and under physiological pH, thus minimizing biological sample handling. J. K. Leland et al., *Electrogenerated Chemiluminescence: An Oxidative-Reduction Type ECL Reactions Sequence Using Triprophyl Amine*, 137 J. Electrochemical Soc. 3127-3131 (1990); WO 90/05296; and U.S. Pat. No. 5,541,113. Moreover, the luminescence of these compounds may be enhanced by the addition of various cofactors, such as amines.

A tris-bipyridine ruthenium (II) complex, for example, may be attached to a secondary antibody using strategies well known in the art, including attachment to lysine amino groups, cysteine sulfhydryl groups, and histidine imidazole groups. In a typical ELISA immunoassay, secondary antibodies would recognize antibodies bound to antigens, but not unbound antigens. After washing nonspecific binding complexes, the tris-bipyridine ruthenium (II) complex may be excited by chemical, photochemical, and electrochemical excitation means, such as by applying current to the array (e.g., WO 86/02734). The excitation would result in a double oxidation reaction of the tris-bipyridine ruthenium (II) complex, resulting in luminescence that could be detected by, for example, a photomultiplier tube. Instruments for detecting luminescence are well known in the art and are commercially available, for example, from IGEN, Inc. (Rockville, Md.).

Solid state color detection circuitry may also be used to monitor the color reactions on the array and, on command, compare the color patterns before and after the sample application. A color camera image may also be used and the pixel information analyzed to obtain the same information.

Still another method involves detection using a surface plasmon resonance (SPR) chip. The surface of the chip is scanned before and after sample application and a comparison is made. The SPR chip relies on the refraction of light when the molecules of interest may be exposed to a light source. Each molecule has its own refraction index by which it may be identified. This method requires precise positioning and control circuitry to scan the chip accurately.

Yet another method involves a fluid rinse of the array with a fluorescing reagent. The antigens that combine with the biological sample will fluoresce and may be detected with a charge-coupled device (CCD) array. The output of such a CCD array is analyzed to determine the unique pattern associated with each sample. Speed is not a factor with any of the methods since the chemical combining of sample and reference takes minutes to occur.

Moreover, array scanners are commercially available, such as from Genetic MicroSystems, Inc. The GMS 418 Array Scanner uses laser optics to rapidly move a focused beam of light over the array. This system uses a dual-wavelength system including high-powered, solid-state lasers that generate high excitation energy to allow for reduced excitation time. At a scanning speed of 30 Hz, the GMS 418 may scan a 22×75-mm slide with 10-μm resolution in about four minutes.

Software for image analysis obtained with an array scanner is readily available. Available software packages include ImaGene (BioDiscovery, Los Angeles, Calif.); ScanAlyze (available at no charge; developed by Mike Eisen, Stanford University, Palo Alto, Calif.); De-Array (developed by Yidong Chen and Jeff Trent of the National Institutes of Health; used with IP Lab from Scanalytics, Inc., Fairfax, Va.); Pathways (Research Genetics, Huntsville, Ala.); GEM Tools (Incyte Pharmaceuticals, Inc., Palo Alto, Calif.); and Imaging Research (Amersham Pharmacia Biotech, Inc., Piscataway, N.J.).

Once interactions between the antigens and antibodies have been identified and quantified, the signals may be digitized. The digitized antibody profile may serve as a signature that identifies the source of the biological sample. Depending on the array used, the digitized data may take numerous forms. For example, the array may include 10 columns and 10 rows for a total number of 100 spots, each including at least one antigen. After the biological sample including the antibodies is added to the array and allowed to incubate, interactions between antigens and antibodies in the biological sample may be identified and quantified. In each spot, an interaction between the antigen in the spot and the antibody in the biological sample will either result in or not result in a quantifiable signal. In one embodiment, the results of the antibody profile may be digitized by, by way of non limiting example, ascribing each one of the 100 spots a numerical value of either "0," if a quantifiable signal was not obtained, or "1," if a quantifiable signal was obtained. Using this method, the digitized antibody profile may comprise a unique set of zeroes and ones. It will be understood that the use of 1 and 0 is merely exemplary and that any set of values or indicators may be used to signify the absence, presence, or intensity of a particular signal.

The numerical values "0" or "1" may, of course, be normalized to signals obtained in internal control spots so that digitized antibody profiles obtained at a later time may be properly compared. For example, one or several of the spots may contain a known antigen, which will remain constant over time. Therefore, if a subsequent biological sample is more or less dilute than a previous biological sample, the signals may be normalized using the signals from the known antigen.

It will be appreciated by one skilled in the art that other methods of digitizing the antibody profile exist and may be used. For example, rather than ascribing each spot with a numerical value of "0" or "1," the numerical value may be incremental and directly proportional to the strength of the signal.

Statistical Analysis

The antibody profiles obtained from the plurality of individuals may be analyzed using conventional discriminant analysis methods to determine proteins useful in discriminating or identifying an individual from one or more other individuals. For example, discriminant proteins may be determined using forward selection, backward elimination, or stepwise selection to determine a subset of proteins that best reveals differences among the classes (i.e., the individuals). The STEPDISC procedure, which is available from SAS Institute, Inc. (Cary, N.C.), may be used to perform a stepwise discriminant analysis to select a subset of the proteins useful in discriminating among individuals. Signals from a set of proteins that make up each class may be assumed to be multivariate normal with a common covariance matrix.

Using the STEPDISC procedure, variables (in particular, signals from particular proteins) may be chosen to enter or leave the model according to the significance level of an F-test from an analysis of covariance, where the variables already chosen act as covariates and the variable under consideration is the dependent variable. In other embodiments, a variable could be chosen to enter or leave the model according to whether the squared partial correlation for its prediction using the class variable (and controlling for the effects of the other variables already in the model) is high.

In some embodiments, the discriminant proteins useful in discriminating or identifying an individual may be determined by calculating various discriminant functions for classifying observations using the protein signals. Linear or quadratic discriminant functions may be used for data with approximately multivariate normal within-class distributions. Nonparametric methods may be used without making any assumptions about these distributions.

One or more of the discriminant proteins may be used to identify an individual, to distinguish between individuals, or to establish or rule out the source of a biological sample. In some embodiments, one or more of the discriminant proteins may be used as part of a test panel. For example, discriminant proteins may be immobilized on a support in the form of an array as described above to form a protein array useful in discriminating among individuals and/or sources of a biological sample. However, other methods of detecting an interaction between a discriminant protein and an antibody present in a biological sample, such as conventional protein affinity chromatography methods, affinity blotting methods, immunoprecipitation methods, and cross-linking methods, may also be used. In embodiments, the array or test panel may be used to generate an antibody profile which may be used to distinguish between individuals in a population, or to establish or rule out the source of a biological sample within a population, wherein the population may comprise 1 million, 10 million, 100 million, 1 billion, 10 billion, 100 billion, or more individuals.

The array may include several discriminant proteins, each of which may be immobilized on a support. The array may include less than about 200, 175, 170, 150, 125, 110, 100, 75, or 50 discriminant proteins. For example, the test panel for discriminating or identifying an individual may include from about 20 to about 90 discriminant proteins, and more particularly, from about 45 to about 80 discriminant proteins, less than about 100 discriminant proteins, less than about 110 discriminant proteins, or less than about 170 discriminant proteins. With "X" different profiles that are each independent, the probability that no two different people have the same profile among "m" people can be shown to be equal to $\exp[-m*m/(2X)]$. As a non-limiting example, greater than about 76 independent discriminant proteins may be used to distinguish an individual among a population of about 10 billion individuals, the probability of a match between two different individuals being less than about 0.0001. As another non-limiting example, greater than about 86 independent discriminant proteins may be used to distinguish an individual among a population of about 100 billion individuals, the probability of a match between two different individuals being less than about 0.0001. Examples of discriminant proteins include, but are not limited to, those proteins presented in Table 1.

TABLE 1

| SEQ ID NO | Protein ID |
|---|---|
| SEQ ID NO: 1 | PM_2149 |
| SEQ ID NO: 2 | PM_2151 |
| SEQ ID NO: 3 | BC010125.1 |
| SEQ ID NO: 4 | BC011414.1 |
| SEQ ID NO: 5 | BC012945.1 |
| SEQ ID NO: 6 | BC014409.1 |
| SEQ ID NO: 7 | BC015219.1 |
| SEQ ID NO: 8 | BC016470.2 |
| SEQ ID NO: 9 | BC018206.1 |
| SEQ ID NO: 10 | BC018404.1 |
| SEQ ID NO: 11 | BC019039.2 |
| SEQ ID NO: 12 | BC019315.1 |
| SEQ ID NO: 13 | BC021189.2 |
| SEQ ID NO: 14 | BC023152.1 |
| SEQ ID NO: 15 | BC026175.1 |
| SEQ ID NO: 16 | BC026346.1 |
| SEQ ID NO: 17 | BC032825.2 |
| SEQ ID NO: 18 | BC033711.1 |
| SEQ ID NO: 19 | BC036123.1 |
| SEQ ID NO: 20 | BC040949.1 |
| SEQ ID NO: 21 | BC050377.1 |
| SEQ ID NO: 22 | BC052805.1 |
| SEQ ID NO: 23 | BC053602.1 |
| SEQ ID NO: 24 | BC060824.1 |
| SEQ ID NO: 25 | NM_015138.2 |
| SEQ ID NO: 26 | NM_175887.2 |
| SEQ ID NO: 27 | NM_000394.2 |
| SEQ ID NO: 28 | NM_000723.3 |
| SEQ ID NO: 29 | NM_001008220.1 |
| SEQ ID NO: 30 | NM_001106.2 |
| SEQ ID NO: 31 | NM_001312.2 |
| SEQ ID NO: 32 | NM_001537.1 |
| SEQ ID NO: 33 | NM_002737 |
| SEQ ID NO: 34 | NM_002740 |
| SEQ ID NO: 35 | NM_002744 |
| SEQ ID NO: 36 | NM_003907.1 |
| SEQ ID NO: 37 | NM_003910.2 |
| SEQ ID NO: 38 | NM_004064.2 |
| SEQ ID NO: 39 | NM_004394.1 |

TABLE 1-continued

| SEQ ID NO | Protein ID |
|---|---|
| SEQ ID NO: 40 | NM_004845.3 |
| SEQ ID NO: 41 | NM_004965.3 |
| SEQ ID NO: 42 | NM_005030 |
| SEQ ID NO: 43 | NM_005246.1 |
| SEQ ID NO: 44 | NM_006007.1 |
| SEQ ID NO: 45 | NM_006218.2 |
| SEQ ID NO: 46 | NM_006628.4 |
| SEQ ID NO: 47 | NM_006819.1 |
| SEQ ID NO: 48 | NM_012472.1 |
| SEQ ID NO: 49 | NM_014240.1 |
| SEQ ID NO: 50 | NM_014245.1 |
| SEQ ID NO: 51 | NM_014460.2 |
| SEQ ID NO: 52 | NM_014622.4 |
| SEQ ID NO: 53 | NM_014891.1 |
| SEQ ID NO: 54 | NM_014943.3 |
| SEQ ID NO: 55 | NM_015149.2 |
| SEQ ID NO: 56 | NM_015417.2 |
| SEQ ID NO: 57 | NM_015509.2 |
| SEQ ID NO: 58 | NM_016096.1 |
| SEQ ID NO: 59 | NM_016520.1 |
| SEQ ID NO: 60 | NM_017855.2 |
| SEQ ID NO: 61 | NM_017949.1 |
| SEQ ID NO: 62 | NM_018326.1 |
| SEQ ID NO: 63 | NM_018584.4 |
| SEQ ID NO: 64 | NM_024718.2 |
| SEQ ID NO: 65 | NM_024826.1 |
| SEQ ID NO: 66 | NM_025241.1 |
| SEQ ID NO: 67 | NM_032345.1 |
| SEQ ID NO: 68 | NM_032368.3 |
| SEQ ID NO: 69 | NM_079420.1 |
| SEQ ID NO: 70 | NM_080390.3 |
| SEQ ID NO: 71 | NM_138623.2 |
| SEQ ID NO: 72 | NM_145796.2 |
| SEQ ID NO: 73 | NM_153757.1 |
| SEQ ID NO: 74 | NM_177973.1 |
| SEQ ID NO: 75 | NM_178010.1 |
| SEQ ID NO: 76 | NM_199124.1 |
| SEQ ID NO: 77 | NM_201262.1 |
| SEQ ID NO: 78 | NM_203284.1 |
| SEQ ID NO: 79 | NM_205853.1 |
| SEQ ID NO: 80 | NM_212540.1 |
| SEQ ID NO: 81 | NM_001810.5 |
| SEQ ID NO: 82 | BC009055.1 |
| SEQ ID NO: 83 | BC011707.1 |
| SEQ ID NO: 84 | BC014975.1 |
| SEQ ID NO: 85 | BC015803.1 |
| SEQ ID NO: 86 | BC016330.1 |
| SEQ ID NO: 87 | BC017070.1 |
| SEQ ID NO: 88 | BC017943.1 |
| SEQ ID NO: 89 | BC018929.1 |
| SEQ ID NO: 90 | BC024725.1 |
| SEQ ID NO: 91 | BC029112.1 |
| SEQ ID NO: 92 | BC030711.2 |
| SEQ ID NO: 93 | BC031687.1 |
| SEQ ID NO: 94 | BC033196.1 |
| SEQ ID NO: 95 | BC034954.2 |
| SEQ ID NO: 96 | BC043247.2 |
| SEQ ID NO: 97 | BC050616.1 |
| SEQ ID NO: 98 | BC070334.1 |
| SEQ ID NO: 99 | NM_176791.2 |
| SEQ ID NO: 100 | NM_000666.1 |
| SEQ ID NO: 101 | NM_001004299.1 |
| SEQ ID NO: 102 | NM_001009609.1 |
| SEQ ID NO: 103 | NM_001348.1 |
| SEQ ID NO: 104 | NM_002444.1 |
| SEQ ID NO: 105 | NM_002498.1 |
| SEQ ID NO: 106 | NM_003141.2 |
| SEQ ID NO: 107 | NM_004527.2 |
| SEQ ID NO: 108 | NM_004844.1 |
| SEQ ID NO: 109 | NM_004881.1 |
| SEQ ID NO: 110 | NM_004922.2 |
| SEQ ID NO: 111 | NM_005400 |
| SEQ ID NO: 112 | NM_006403.2 |
| SEQ ID NO: 113 | NM_006807.2 |
| SEQ ID NO: 114 | NM_012247.3 |
| SEQ ID NO: 115 | NM_012325.1 |
| SEQ ID NO: 116 | NM_015122.1 |
| SEQ ID NO: 117 | NM_017451.1 |

TABLE 1-continued

| SEQ ID NO | Protein ID |
| --- | --- |
| SEQ ID NO: 118 | NM_018132.1 |
| SEQ ID NO: 119 | NM_018357.2 |
| SEQ ID NO: 120 | NM_023930.1 |
| SEQ ID NO: 121 | NM_052848.1 |
| SEQ ID NO: 122 | NM_138565.1 |
| SEQ ID NO: 123 | NM_152318.1 |
| SEQ ID NO: 124 | NM_182800.2 |
| SEQ ID NO: 125 | NM_198501.1 |
| SEQ ID NO: 126 | NM_207005.1 |
| SEQ ID NO: 127 | NM_207350.1 |
| SEQ ID NO: 128 | NM_212539.1 |
| SEQ ID NO: 129 | BC053321.1 |
| SEQ ID NO: 130 | NM_004304.2 |
| SEQ ID NO: 131 | CR457399 |
| SEQ ID NO: 132 | NM_002055.1 |
| SEQ ID NO: 133 | NM_019884.2 |
| SEQ ID NO: 134 | NM_001699.2 |
| SEQ ID NO: 135 | BC107750.1 |
| SEQ ID NO: 136 | BC110580.1 |
| SEQ ID NO: 137 | NM_002378.3 |
| SEQ ID NO: 138 | NM_002758.2 |
| SEQ ID NO: 139 | NM_002093.2 |
| SEQ ID NO: 140 | NM_030662.2 |
| SEQ ID NO: 141 | NM_000269.1 |
| SEQ ID NO: 142 | NM_002031.2 |
| SEQ ID NO: 143 | NM_001715.2 |
| SEQ ID NO: 144 | NM_002202.1 |
| SEQ ID NO: 145 | NM_002745.1 |
| SEQ ID NO: 146 | BC012289.1 |
| SEQ ID NO: 147 | BC014969.1 |
| SEQ ID NO: 148 | BC017572.1 |
| SEQ ID NO: 149 | BC020221.1 |
| SEQ ID NO: 150 | BC023567.2 |
| SEQ ID NO: 151 | BC031213.1 |
| SEQ ID NO: 152 | BC037900.2 |
| SEQ ID NO: 153 | BC038838.1 |
| SEQ ID NO: 154 | BC053594.1 |
| SEQ ID NO: 155 | BC053895.1 |
| SEQ ID NO: 156 | BC054520.1 |
| SEQ ID NO: 157 | BC062338.1 |
| SEQ ID NO: 158 | BC065370.1 |
| SEQ ID NO: 159 | NM_000461.3 |
| SEQ ID NO: 160 | NM_001005862 |
| SEQ ID NO: 161 | NM_001006634.1 |
| SEQ ID NO: 162 | NM_001007792 |
| SEQ ID NO: 163 | NM_001033551.1 |
| SEQ ID NO: 164 | NM_001105.2 |
| SEQ ID NO: 165 | NM_001699.3 |
| SEQ ID NO: 166 | NM_001786.2 |
| SEQ ID NO: 167 | NM_001799 |
| SEQ ID NO: 168 | NM_002031.1 |
| SEQ ID NO: 169 | NM_002378.2 |
| SEQ ID NO: 170 | NM_002446.2 |
| SEQ ID NO: 171 | NM_002737.1 |
| SEQ ID NO: 172 | NM_002745.2 |
| SEQ ID NO: 173 | NM_003390.2 |
| SEQ ID NO: 174 | NM_005123.1 |
| SEQ ID NO: 175 | NM_005550.2 |
| SEQ ID NO: 176 | NM_006651.2 |
| SEQ ID NO: 177 | NM_007045.2 |
| SEQ ID NO: 178 | NM_014215.1 |
| SEQ ID NO: 179 | NM_014424.3 |
| SEQ ID NO: 180 | NM_015621.2 |
| SEQ ID NO: 181 | NM_018664.1 |
| SEQ ID NO: 182 | NM_022730.1 |
| SEQ ID NO: 183 | NM_024591.1 |
| SEQ ID NO: 184 | NM_024826.1 |
| SEQ ID NO: 185 | NM_031988.1 |
| SEQ ID NO: 186 | NM_032883.1 |
| SEQ ID NO: 187 | NM_032943.2 |
| SEQ ID NO: 188 | NM_133265.2 |
| SEQ ID NO: 189 | NM_138565.1 |
| SEQ ID NO: 190 | NM_139181.1 |
| SEQ ID NO: 191 | NM_144659.1 |
| SEQ ID NO: 192 | NM_152763.2 |
| SEQ ID NO: 193 | NM_173541.1 |
| SEQ ID NO: 194 | NM_178151.1 |
| SEQ ID NO: 195 | NM_198175.1 |
| SEQ ID NO: 196 | NM_198395.1 |
| SEQ ID NO: 197 | NM_001810.5 |

In embodiments of the invention, a protein array may comprise 1, 2, 3, 4, 5, 10, 15, 20, 25, 50, or more discriminant proteins selected from the group consisting of SEQ ID NOs: 1-80, SEQ ID NOs:1-45, SEQ ID NOs:1-3, 5, 6, 8, 9, 11, 12, 15-18, 22-24, 26, 27, 29, 33, 38, 41, 44, 46-48, 51, 20, 54, 57-60, 62, 65, 68, 70, 72, 72-75, 77, 79, and 81-145, and SEQ ID NOs:1-9, 11-13, 15-20, 22-24, 26-30, 33, 35, 36, 38-41, 44, 46-54, 57-60, 62, 63, 66, 68, 70, 72-80, 82-121, 123-128, 130, 132, 133, 139, 140, 143, and 146-197. In embodiments, a protein array may consist of SEQ ID NOs:1-80, SEQ ID NOs:1-45, SEQ ID NOs:1-3, 5, 6, 8, 9, 11, 12, 15-18, 22-24, 26, 27, 29, 33, 38, 41, 44, 46-48, 51, 20, 54, 57-60, 62, 65, 68, 70, 72, 72-75, 77, 79, and 81-145, and SEQ ID NOs:1-9, 11-13, 15-20, 22-24, 26-30, 33, 35, 36, 38-41, 44, 46-54, 57-60, 62, 63, 66, 68, 70, 72-80, 82-121, 123-128, 130, 132, 133, 139, 140, 143, and 146-197.

In an embodiment of the invention, a protein array including discriminant proteins may be used for forensic analysis for matching a biological sample to an individual such as, for example, a criminal suspect. Forensic samples obtained from crime scenes are often subject to drying of the samples, small sample sizes, mixing with samples from more than one individual, adulteration with chemicals, and the like. The present method provides the advantages of rapid analysis, simplicity, low cost, and accuracy for matching forensic samples with suspects. For example, the forensic sample and a sample from one or more suspects may be obtained according to methods well known in the art. The samples may be tested against the array and compared. If the discriminant proteins obtained from the samples match, it may be concluded that the forensic sample was obtained from the matching suspect. If no match of discriminant proteins is obtained, then none of the suspects was the source of the forensic sample.

EXAMPLES

Example 1

Serum samples from ninety-four (94) individuals were profiled against a high throughput protein array with over 8000 proteins and the data from these chips was statistically analyzed to determine proteins useful for discriminating among sets of individuals in a population. The ninety-four (94) individuals included nineteen (19) Asian individuals, twenty (20) African American individuals, twenty (20) Native American individuals, and thirty-five (35) Caucasian individuals. For quality assurance (QA), the arrays contained the immobilized proteins in pairs on a support. Thus, each array provided two opportunities for antigen/antibody binding for each protein.

The serum samples were diluted 1:150 and used to probe human ProtoArray®. The arrays were blocked for 1 hour and then incubated with the serum samples for 90 minutes at about 4° C. without shaking. The arrays were then transferred to ice and washed about three times by adding about 20 ml buffer (1×PBS, 5 mM $MgCl_2$, 0.5 mM DTT, 0.05% TRITON® X-100, 5% Glycerol, 1% BSA) to the arrays, incubating the arrays with the buffer for 8 minutes at 4° C., and decanting the buffer from the arrays by inverting. The arrays were incubated with anti-human IgG antibody conjugated to AlexaFluor 647 for about 90 minutes, washed as above and dried. The arrays were scanned using a ScanArray Express® 3.0 HT microarray scanner, which is available commercially from Perkin Elmer, Inc. (Waltham, Mass.). The images were captured from the microarray scanner using a 633 nm laser with the scanner set to 10 μm resolution. Following scanning, data was acquired using ImaGene® 8.0 microarray analysis software from BioDiscovery (El Segundo, Calif.). Background-subtracted signals from each population were normalized utilizing a quantile normalization strategy. Subjects were distinguished from one another using conventional discriminant analysis. The STEPDISC procedure from SAS Institute, Inc. was utilized to identify discriminant proteins based on the logarithms of the intensities detected. The discriminant proteins of interest were identified as significant in distinguishing between individuals. A list of 80 discriminating proteins from among the over 8,000 on the arrays was determined. The 80 discriminating proteins are listed in Table 2.

TABLE 2

| SEQ ID NO | Protein ID | SelOrdAll | MinPSeeOrNot | sRatio | maxCorrAfter |
|---|---|---|---|---|---|
| SEQ ID NO: 1 | PM_2149 | 16 | 0.45 | 22.1 | 0.683 |
| SEQ ID NO: 2 | PM_2151 | 99 | 0.25 | 13.4 | 0.585 |
| SEQ ID NO: 3 | BC010125.1 | 62 | 0.23 | 15.6 | 0.500 |
| SEQ ID NO: 4 | BC011414.1 | 15 | 0.40 | 19.9 | 0.482 |
| SEQ ID NO: 5 | BC012945.1 | 38 | 0.33 | 18.4 | 0.570 |
| SEQ ID NO: 6 | BC014409.1 | . | 0.32 | 10.7 | 0.448 |
| SEQ ID NO: 7 | BC015219.1 | 76 | 0.29 | 15.6 | 0.652 |
| SEQ ID NO: 8 | BC016470.2 | 74 | 0.19 | 14.6 | 0.579 |
| SEQ ID NO: 9 | BC018206.1 | 31 | 0.38 | 16.1 | 0.551 |
| SEQ ID NO: 10 | BC018404.1 | 93 | 0.27 | 19.0 | 0.754 |
| SEQ ID NO: 11 | BC019039.2 | 33 | 0.41 | 17.2 | 0.544 |
| SEQ ID NO: 12 | BC019315.1 | 27 | 0.48 | 17.8 | 0.846 |
| SEQ ID NO: 13 | BC021189.2 | 29 | 0.34 | 17.2 | 0.488 |
| SEQ ID NO: 14 | BC023152.1 | 6 | 0.10 | 25.3 | 0.752 |
| SEQ ID NO: 15 | BC026175.1 | 50 | 0.39 | 15.6 | 0.582 |
| SEQ ID NO: 16 | BC026346.1 | 78 | 0.48 | 16.4 | 0.360 |
| SEQ ID NO: 17 | BC032825.2 | 13 | 0.10 | 18.9 | 0.491 |
| SEQ ID NO: 18 | BC033711.1 | 72 | 0.29 | 14.6 | 0.567 |
| SEQ ID NO: 19 | BC036123.1 | 101 | 0.35 | 15.0 | 0.649 |
| SEQ ID NO: 20 | BC040949.1 | 45 | 0.37 | 17.9 | 0.523 |
| SEQ ID NO: 21 | BC050377.1 | 70 | 0.14 | 11.0 | 0.310 |
| SEQ ID NO: 22 | BC052805.1 | 56 | 0.29 | 16.6 | 0.501 |
| SEQ ID NO: 23 | BC053602.1 | 42 | 0.32 | 16.1 | 0.621 |
| SEQ ID NO: 24 | BC060824.1 | 12 | 0.28 | 19.4 | 0.421 |
| SEQ ID NO: 25 | NM_015138.2 | 91 | 0.33 | 13.3 | 0.607 |
| SEQ ID NO: 26 | NM_175887.2 | 34 | 0.43 | 15.4 | 0.537 |
| SEQ ID NO: 27 | NM_000394.2 | 44 | 0.38 | 20.2 | 0.737 |
| SEQ ID NO: 28 | NM_000723.3 | 200 | 0.22 | 9.4 | 0.580 |
| SEQ ID NO: 29 | NM_001008220.1 | 17 | 0.22 | 21.7 | 0.405 |
| SEQ ID NO: 30 | NM_001106.2 | 22 | 0.41 | 20.3 | 0.303 |
| SEQ ID NO: 31 | NM_001312.2 | 81 | 0.42 | 13.2 | 0.619 |
| SEQ ID NO: 32 | NM_001537.1 | 84 | 0.49 | 23.5 | 0.733 |
| SEQ ID NO: 33 | NM_002737 | 73 | 0.47 | 10.0 | 0.300 |
| SEQ ID NO: 34 | NM_002740 | 79 | 0.28 | 12.4 | 0.620 |
| SEQ ID NO: 35 | NM_002744 | 3 | 0.42 | 22.4 | 0.215 |
| SEQ ID NO: 36 | NM_003907.1 | 57 | 0.37 | 14.8 | 0.440 |
| SEQ ID NO: 37 | NM_003910.2 | 63 | 0.12 | 12.7 | 0.594 |
| SEQ ID NO: 38 | NM_004064.2 | 54 | 0.20 | 13.8 | 0.422 |
| SEQ ID NO: 39 | NM_004394.1 | 58 | 0.48 | 16.3 | 0.641 |
| SEQ ID NO: 40 | NM_004845.3 | 30 | 0.25 | 18.0 | 0.432 |
| SEQ ID NO: 41 | NM_004965.3 | 97 | 0.46 | 11.4 | 0.648 |
| SEQ ID NO: 42 | NM_005030 | 95 | 0.41 | 14.2 | 0.683 |
| SEQ ID NO: 43 | NM_005246.1 | 77 | 0.22 | 9.3 | 0.625 |
| SEQ ID NO: 44 | NM_006007.1 | 80 | 0.24 | 13.3 | 0.417 |
| SEQ ID NO: 45 | NM_006218.2 | 90 | 0.24 | 8.2 | 0.573 |
| SEQ ID NO: 46 | NM_006628.4 | 66 | 0.29 | 15.0 | 0.538 |
| SEQ ID NO: 47 | NM_006819.1 | 4 | 0.22 | 17.9 | 0.356 |
| SEQ ID NO: 48 | NM_012472.1 | 11 | 0.49 | 23.0 | 0.578 |
| SEQ ID NO: 49 | NM_014240.1 | 19 | 0.44 | 18.9 | 0.459 |
| SEQ ID NO: 50 | NM_014245.1 | 18 | 0.29 | 22.9 | 0.676 |
| SEQ ID NO: 51 | NM_014460.2 | 21 | 0.32 | 19.7 | 0.414 |
| SEQ ID NO: 52 | NM_014622.4 | 65 | 0.49 | 15.7 | 0.566 |
| SEQ ID NO: 53 | NM_014891.1 | 32 | 0.23 | 19.1 | 0.343 |
| SEQ ID NO: 54 | NM_014943.3 | 71 | 0.16 | 12.7 | 0.519 |
| SEQ ID NO: 55 | NM_015149.2 | 96 | 0.18 | 11.4 | 0.665 |
| SEQ ID NO: 56 | NM_015417.2 | 8 | 0.12 | 19.3 | 0.353 |
| SEQ ID NO: 57 | NM_015509.2 | 43 | 0.23 | 12.8 | 0.554 |
| SEQ ID NO: 58 | NM_016096.1 | 41 | 0.28 | 16.0 | 0.516 |
| SEQ ID NO: 59 | NM_016520.1 | 60 | 0.38 | 13.3 | 0.471 |
| SEQ ID NO: 60 | NM_017855.2 | 69 | 0.29 | 14.2 | 0.578 |
| SEQ ID NO: 61 | NM_017949.1 | 49 | 0.16 | 16.2 | 0.630 |
| SEQ ID NO: 62 | NM_018326.1 | 26 | 0.39 | 17.5 | 0.254 |
| SEQ ID NO: 63 | NM_018584.4 | 7 | 0.37 | 21.7 | 0.448 |
| SEQ ID NO: 64 | NM_024718.2 | 103 | 0.17 | 11.0 | 0.495 |
| SEQ ID NO: 65 | NM_024826.1 | 20 | 0.41 | 17.8 | 0.328 |

TABLE 2-continued

| SEQ ID NO | Protein ID | SelOrdAll | MinPSeeOrNot | sRatio | maxCorrAfter |
|---|---|---|---|---|---|
| SEQ ID NO: 66 | NM_025241.1 | 48 | 0.43 | 13.2 | 0.268 |
| SEQ ID NO: 67 | NM_032345.1 | 85 | 0.16 | 13.4 | 0.765 |
| SEQ ID NO: 68 | NM_032368.3 | 39 | 0.36 | 19.2 | 0.635 |
| SEQ ID NO: 69 | NM_079420.1 | 51 | 0.45 | 14.0 | 0.643 |
| SEQ ID NO: 70 | NM_080390.3 | 86 | 0.23 | 15.3 | 0.582 |
| SEQ ID NO: 71 | NM_138623.2 | 67 | 0.12 | 14.4 | 0.538 |
| SEQ ID NO: 72 | NM_145796.2 | 64 | 0.26 | 11.4 | 0.590 |
| SEQ ID NO: 73 | NM_153757.1 | 46 | 0.46 | 16.8 | 0.402 |
| SEQ ID NO: 74 | NM_177973.1 | 10 | 0.26 | 18.5 | 0.290 |
| SEQ ID NO: 75 | NM_178010.1 | 9 | 0.31 | 16.8 | 0.124 |
| SEQ ID NO: 76 | NM_199124.1 | 28 | 0.38 | 14.0 | 0.252 |
| SEQ ID NO: 77 | NM_201262.1 | 14 | 0.27 | 17.5 | 0.118 |
| SEQ ID NO: 78 | NM_203284.1 | 5 | 0.31 | 26.9 | 0.277 |
| SEQ ID NO: 79 | NM_205853.1 | 25 | 0.44 | 17.7 | 0.208 |
| SEQ ID NO: 80 | NM_212540.1 | 75 | 0.17 | 12.4 | . |

The discriminant proteins of Table 2 were selected to discriminate an individual based on the primary criterion that the logarithms of the associated intensity signals appear as selected variables in a STEPDISC model. Several STEPDISC models were tested. One used only data from the first QA sample associated with each protein. A second model used only data from the other QA sample. A third model used average values, and a fourth used all the data (a total of 198 sets of protein intensity data from 99 non-blank arrays). The "SelOrdAll" column in Table 2 shows the order of selection of proteins from the fourth model. The values are ranked, so "1" corresponds to the first protein selected, "2" for the second, and so forth. The protein (SEQ ID NO:6) with no value in this column was selected in a fifth STEPDISC model that used just data from subjects with replication (specifically, data from the two individuals with more than one array in the data set were used in this model). The fourth run identified a total of 197 proteins. The filter sought proteins among the first 100 selected using this model. For later protein lists that needed more proteins than just the 80, additional proteins selected in the first three STEPDISC models were included in the screening list.

The initial list was refined using three additional filters. First, proteins retained on the list had to have the between-subject standard deviation as the largest of the estimated standard deviations. The standard deviations for this filter were obtained using a conventional "components of variance" analysis for each protein that sought variation between subjects, arrays, spots on the array and the QA sampling variation. The ratio of the between-subject estimate divided by the QA sample standard deviation estimate is shown in the "sRatio" column of Table 2. This ratio was used as a further criteria in narrowing the selection (see further below).

The second criterion used in refining the list of discriminant proteins to get just 80 was related to the probability of detection. For the example embodiment of the invention, a median intensity of greater than 1500 was assumed to be required in order to observe the presence of antigen/antibody bonding for a protein. The fraction of array data exceeding 1500 was tabulated for each protein. In initial data screening, this fraction was required to be at least 0.1 and less than 0.9. If nearly all the sample intensities are invisible, or nearly all are visible, there is less potential for discriminating between people. The minimum of the probability of visibility, and 1−this probability, was used further as described below. This attribute of a protein is denoted as "MinPSeeOrNot" in Table 2.

To determine the subset of 45 discriminant proteins listed in Table 2 below, pairwise correlation coefficients for all pairs among the 80 proteins were evaluated. The correlations were estimated using the data set of people with just one array per person (92 arrays), so that complete independence in the results would be ideal. The correlations were estimated using JMP® statistical software from SAS Institute. For each of the 80 proteins, a maximum correlation was identified. The pair of proteins in the array with the maximum correlation of all of these was identified. The protein in this pair with other relatively high correlations was identified as the worst protein from the correlation standpoint. This protein was recorded and then all correlations associated with it were removed from further consideration. This process was repeated using the remaining data, leading to identification of the second-worst protein and its highest correlation, conditioned on the first (worst) protein being omitted. This process was repeated until only two proteins remained in the set of data being considered. These are the two most "independent" proteins among the set of 80. The maximum correlation estimated between a given protein and some other protein, given that the more highly-correlated proteins have been removed from the data set, is shown as "MaxCorrAfter" in Table 2. The most discriminating proteins have the lowest values for "MaxCorrAfter."

The 45 discriminant proteins in Table 2 were identified using the following cutoff values for the three filters discussed above: sRatio greater than or equal to about 11, a "MaxCorrAfter" less than about 0.6, and "MinPSeeOrNot" greater than about 0.2. The numbers in this filter were selected by trial and error to retain exactly 45 proteins.

TABLE 3

45 proteins, sorted on sRatio.

| Protein ID | SEQ ID NO | selOrdAll | MinPSeeOrNot | sRatio | maxCorrAfter |
|---|---|---|---|---|---|
| NM_203284.1 | SEQ ID NO: 78 | 5 | 0.3131 | 26.9 | 0.277 |
| NM_012472.1 | SEQ ID NO: 48 | 11 | 0.4949 | 23.0 | 0.578 |
| NM_002744 | SEQ ID NO: 35 | 3 | 0.4192 | 22.4 | 0.215 |
| NM_018584.4 | SEQ ID NO: 63 | 7 | 0.3737 | 21.7 | 0.448 |

TABLE 3-continued 45 proteins, sorted on sRatio.

| Protein ID | SEQ ID NO | selOrdAll | MinPSeeOrNot | sRatio | maxCorrAfter |
|---|---|---|---|---|---|
| NM_001008220.1 | SEQ ID NO: 29 | 17 | 0.2172 | 21.7 | 0.405 |
| NM_001106.2 | SEQ ID NO: 30 | 22 | 0.4091 | 20.3 | 0.303 |
| BC011414.1 | SEQ ID NO: 4 | 15 | 0.4040 | 19.9 | 0.482 |
| NM_014460.2 | SEQ ID NO: 51 | 21 | 0.3182 | 19.7 | 0.414 |
| BC060824.1 | SEQ ID NO: 24 | 12 | 0.2828 | 19.4 | 0.421 |
| NM_014891.1 | SEQ ID NO: 53 | 32 | 0.2323 | 19.1 | 0.343 |
| NM_014240.1 | SEQ ID NO: 49 | 19 | 0.4444 | 18.9 | 0.459 |
| NM_177973.1 | SEQ ID NO: 74 | 10 | 0.2576 | 18.5 | 0.290 |
| BC012945.1 | SEQ ID NO: 5 | 38 | 0.3333 | 18.4 | 0.570 |
| NM_004845.3 | SEQ ID NO: 40 | 30 | 0.2525 | 18.0 | 0.432 |
| NM_006819.1 | SEQ ID NO: 47 | 4 | 0.2222 | 17.9 | 0.356 |
| BC040949.1 | SEQ ID NO: 20 | 45 | 0.3737 | 17.9 | 0.523 |
| NM_024826.1 | SEQ ID NO: 65 | 20 | 0.4141 | 17.8 | 0.328 |
| NM_205853.1 | SEQ ID NO: 79 | 25 | 0.4394 | 17.7 | 0.208 |
| NM_018326.1 | SEQ ID NO: 62 | 26 | 0.3939 | 17.5 | 0.254 |
| NM_201262.1 | SEQ ID NO: 77 | 14 | 0.2727 | 17.5 | 0.118 |
| BC021189.2 | SEQ ID NO: 13 | 29 | 0.3434 | 17.2 | 0.488 |
| BC019039.2 | SEQ ID NO: 11 | 33 | 0.4091 | 17.2 | 0.544 |
| NM_178010.1 | SEQ ID NO: 75 | 9 | 0.3081 | 16.8 | 0.124 |
| NM_153757.1 | SEQ ID NO: 73 | 46 | 0.4596 | 16.8 | 0.402 |
| BC052805.1 | SEQ ID NO: 22 | 56 | 0.2879 | 16.6 | 0.501 |
| BC026346.1 | SEQ ID NO: 16 | 78 | 0.4798 | 16.4 | 0.360 |
| BC018206.1 | SEQ ID NO: 9 | 31 | 0.3838 | 16.1 | 0.551 |
| NM_016096.1 | SEQ ID NO: 58 | 41 | 0.2828 | 16.0 | 0.516 |
| NM_014622.4 | SEQ ID NO: 52 | 65 | 0.4899 | 15.7 | 0.566 |
| BC026175.1 | SEQ ID NO: 15 | 50 | 0.3889 | 15.6 | 0.582 |
| BC010125.1 | SEQ ID NO: 3 | 62 | 0.2323 | 15.6 | 0.500 |
| NM_175887.2 | SEQ ID NO: 26 | 34 | 0.4293 | 15.4 | 0.537 |
| NM_080390.3 | SEQ ID NO: 70 | 86 | 0.2273 | 15.3 | 0.582 |
| NM_006628.4 | SEQ ID NO: 46 | 66 | 0.2929 | 15.0 | 0.538 |
| NM_003907.1 | SEQ ID NO: 36 | 57 | 0.3737 | 14.8 | 0.440 |
| BC033711.1 | SEQ ID NO: 18 | 72 | 0.2929 | 14.6 | 0.567 |
| NM_017855.2 | SEQ ID NO: 60 | 69 | 0.2879 | 14.2 | 0.578 |
| NM_199124.1 | SEQ ID NO: 76 | 28 | 0.3788 | 14.0 | 0.252 |
| NM_004064.2 | SEQ ID NO: 38 | 54 | 0.2020 | 13.8 | 0.422 |
| PM_2151 | SEQ ID NO: 2 | 99 | 0.2475 | 13.4 | 0.585 |
| NM_016520.1 | SEQ ID NO: 59 | 60 | 0.3838 | 13.3 | 0.471 |
| NM_006007.1 | SEQ ID NO: 44 | 80 | 0.2424 | 13.3 | 0.417 |
| NM_025241.1 | SEQ ID NO: 66 | 48 | 0.4343 | 13.2 | 0.268 |
| NM_015509.2 | SEQ ID NO: 57 | 43 | 0.2273 | 12.8 | 0.554 |
| NM_145796.2 | SEQ ID NO: 72 | 64 | 0.2576 | 11.4 | 0.590 |

While the invention is susceptible to various modifications and implementation in alternative forms, specific embodiments have been shown by way of non-limiting example in the drawing and have been described in detail herein. However, it should be understood that the invention is not intended to be limited to the particular forms disclosed. Rather, the invention includes all modifications, equivalents, and alternatives falling within the scope of the invention as defined by the following appended claims and their legal equivalents.

SEQUENCE LISTING (197 sequences)

SEQ ID NO: 1 - protein, 2768 aa, Homo sapiens
MALVLEIFTLLASICWVSANIFEYQVDAQPLRPCELQRETAFLKQADYVPQCAEDGSFQTVQCQNDGRSCWCVGANGSEVLGSRQPGRPVACLSFCQLQKQQILLSGYINSTDTSYLPQCQDSGDYAPVQCDVQQVQCWCVDAEGMEVYGTRQLGRPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 2 - protein, 447 aa, Homo sapiens [sequence omitted]

SEQ ID NO: 3 - protein, 354 aa, Homo sapiens
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 4 - protein, 505 aa, Homo sapiens [sequence omitted]

SEQ ID NO: 5 - protein, 546 aa, Homo sapiens
DRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPRGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQRGIPDTTSELAGQRDHLPHSADQGTWADSLAVELDFLLDSQIQDALDASDFEAPPEQLFPSGNKPGPCWPGPSSHANGDPVAVAKAQPRTFVGIQASEASRMEDATNVVRGLIVELSNLNRLIMGTHRDLEAFKRLNYRKTKLGGKAPLPYPSKGPGNIPRGDPPWREL

SEQ ID NO: 6 - protein, 204 aa, Homo sapiens [sequence omitted]

SEQ ID NO: 7 - protein, 510 aa, Homo sapiens
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 8 - protein, 583 aa, Homo sapiens [sequence omitted]

SEQ ID NO: 9 - protein, 158 aa, Homo sapiens
MAAQGVGPGPGSAAPPGLEAARQKLALRRKKVLSTEEMELYELAQAAGGGIDPDVFKILVDLLKLNVAPLAVFQMLKSMCAGQRLASEPQDPAAVSLPTSSVPETRGRDKGSAALGGVLALAERSNHEGSSQRMPRQPSATRLPKGGGPGKSPTQGST

SEQ ID NO: 10 - protein, 209 aa, Homo sapiens [sequence omitted]

SEQ ID NO: 11 - protein, 235 aa, Homo sapiens
QRACVAAACTVAARCPGRGVGDRSQSGASYRPICGPKVGGPTEMLRGMYLTRNGNLQRRHTMKEAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 12 - protein, 359 aa, Homo sapiens [sequence omitted]

SEQ ID NO: 13 - protein, 91 aa, Homo sapiens
MCMDPKCEKLAITRSLASAQSLSYHQNQGHRGRLTASLNTLREADLGQVTRVYKSQDSRLGLVHGRTDEQLHSCSRTDQDKAMLELGPHIC

SEQ ID NO: 14 - protein, 470 aa, Homo sapiens
MSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSVSSSQHQAAFLHLWWTVYQNNVLPLYKSVQAGEARASPGHTLCRSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVDLAVSVSQISIEEKVKELSPEEERRKWEEGRIDYMGKDAFARIQEKLDRFLQ

SEQ ID NO: 15 - protein, 209 aa, Homo sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIV

SEQ ID NO: 16 - protein, 292 aa, Homo sapiens
MGNQLDRITHLNYSELPTGDPSGIEKDELRVGVAYFFSDDEEDLDERGQPDKFGVKAPPGCTPCPESPSRHHHHLLHQLVLNETQFSAFRGQECIFSKVSGGPQGADLSVYAVTALPALCEPGDLLELLWLQHAPEPPAPAPHWAVYVGGGQIIHLHQGEIRQDSLYEAGAANVGRVVNSWYRYRPLVAELVVQNACGHLGLKSEEICWTNSESFAAWCRFGKREFKAGGEVPAGTQPPQQQYYLKVHLGENKVHTARFHSLEDLIREKRRIDASGRLRVLQELADLVDDKE

SEQ ID NO: 17 - protein, 279 aa, Homo sapiens [sequence omitted]

SEQ ID NO: 18 - protein, 370 aa, Homo sapiens [sequence omitted]

SEQ ID NO: 19 - protein, 467 aa, Homo sapiens [sequence omitted]

SEQ ID NO: 20 - protein, 514 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 21 - protein, 447 aa, Homo sapiens [sequence omitted]

SEQ ID NO: 22 - protein, 383 aa, Homo sapiens
MERLQKQPLTSPGSVSPSRDSSVPGSPSSIVAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQIYPYEMLVVTNKGRTKLPPGVDRMRLERHLSAEDFSRVFAMSPEEFGKLALWKRNELKKKASLF

SEQ ID NO: 23 - protein, 226 aa, Homo sapiens
MSRIYHDGALRNKAVQSVRLPGAWDPAAHQGGNGVLLEGELIDVSRHSILDTHGRKERYYVLYIRPSHIHRRKFDAKGNEIEPNFSATRKVNTGFLMSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWDD

SEQ ID NO: 24 - protein, 253 aa, Homo sapiens
MEPLQQQQQQQQQQQKQPHLAPLQMDAREKQGQQMREAQFLYAQKLVTQPTLLSATAGRPSGSTPLGPLARVPPTAAVAQVFERGNMNSEPEEEDGGLEDEDGDDEVAEVAEKETQAASKYFHVQKVARQDPRVAPMSNLLPAPGLPPHGQQAKEDHTKDASKASPSVSTAGQPNWNLDEQLKQNGGLAWSDDADGGRGREISRDFAKLYELDGDPERKEFLDDLFVFMQKRGECASTHHSNSGNTDRVPTVC

SEQ ID NO: 25 - protein, 585 aa, Homo sapiens
MKKQANKTASSGSSDKDSSAESSAPEEGEVSDSDSNSSSSSSDSDSSSEDEEFHDGYGEDLMGDEEDRARLEQMTEKEREQELFNRIEKREVLKRRFEIKKKLKTAKKKEKKEKKKKQEEEQEKKKLTQIQESQVTSHNKERRSKRDEKLDKKSQAMEELKAEREKRKNRTAELLAKKQPLKTSEVYSDDEEEEEDDKSSEKSDRSSRTSSSDEEEEKEEIPPKSQPVSLPEELNRVRLSRHKLERWCHMPFFAKTVTGCFVRIGIGNHNSKPVYRVAEITGVVETAKVYQLGGTRTNKGLQLRHGNDQRVFRLEFVSNQEFTESEFMKWKEAMFSAGMQLPTLDEINKKELSIKEALNYKFNDQDIEEIVKEKERFRKAPPNYAMKKTQLLKEKAMAEDLGDQDKAKQIQDQLNELEERAEALDRQRTKNISAISYINQRNREWNIVESEKALVAESHNMKNQQMDPFTRRQCKPTIVSNSRDPAVQAAILAQLNAKYGSGVLPDAPKEMSKGQGKDKDLNSKSASDLSEDLFKVHDFDVKIDLQVPSSESKALAITSKAPPAKDGAPRRSLNLEDYKKRRGLI

SEQ ID NO: 26 - protein, 129 aa, Homo sapiens
MADSGDAGSSGPWWKSLTNSRKKSKEAAVGVPPPAQPAPGEPTPPAPPSPDWTSSSRENQHPNLLGGAGEPPKPDKLYGDKSGSSRRNLKISRSGRFKEKRKVRATLLPEAGRSPEEAGFPGDPHEDKQ

SEQ ID NO: 27 - protein, 173 aa, Homo sapiens
MDVTIQHPWFKRTLGPFYPSRLFDQFFGEGLFEYDLLPFLSSTISPYYRQSLFRTVLDSGISEVRSDRDKFVIFLDVKHFSPEDLTVKVQDDFVEIHGKHNERQDDHGYISREFHRRYRLPSNVDQSALSCSLSADGMLTFCGPKIQTGLDATHAERAIPVSREEKPTSAPSS

SEQ ID NO: 28 - protein, 598 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASAKQKQKSTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQGPYLASGDQPLERATGEHASMHEYPGELGQPPGLYPSSHPPGRAGTLRALSRQDTFDADTPGSRNSAYTELGDSCVDMETDPSEGPGLGDPAGGGTPPARQGSWEDEEEDYEEELTDNRNRGRNKARYCAEGGGPVLGRNKNELEGWGRGVYIR

SEQ ID NO: 29 - protein, 134 aa, Homo sapiens
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEEEEESILDTVLKYLPGPLQDMFKK

SEQ ID NO: 30 - protein, 512 aa, Homo sapiens
MTAPWVALALLWGSLWPGSGRGEAETRECIYYNANWELERTNQSGLERCEGEQDKRLHCYASWANSSGTIELVKKGCWLDDFNCYDRQECVATEENPQVYFCCCEGNFCNERFTHLPEAGGPEVTYEPPPTAPTLLTVLAYSLLPIGGLSLIVLLAFWMYRHRKPPYGHVDIHEDPGPPPPSPLVGLKPLQLLEIKARGRFGCVWKAQLMNDFVAVKIFPLQDKQSWQSEREIFSTPGMKHENLLQFIAAEKRGSNLEVELWLITAFHDKGSLTDYLKGNIITWNELCHVAETMSRGLSYLHEDVPWCRGEGHKPSIAHRDFKSKNVLLKSDLTAVLADFGLAVRFEPGKPPGDTHGQVGTRRYMAPEVLEGAINFQRDAFLRIDMYAMGLVLWELVSRCKAADGPVDEYMLPFEEEIGQHPSLEELQEVVVHKKMRPTIKDHWLKHPGLAQLCVTIEECWDHDAEARLSAGCVEERVSLIRRSVNGTTSDCLVSLVTSVTNVDLPPKESSI

SEQ ID NO: 31 - protein, 206 aa, Homo sapiens
SKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 32 - protein, 76 aa, Homo sapiens
MAETDPKTVQDLTSVVQTLLQQMQDKFQTMSDQIIGRIDDMSSRIDDLEKNIADLMTQAGVEELESENKIPATQKS

SEQ ID NO: 33 - protein, 672 aa, Homo sapiens
MADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEKAKLGPAGNKVISPSEDRKQPSNNLDRVKLTDFNFLMVLGKGSFGKVMLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLDNVMLDSEGHIKIADFGMCKEHMMDGVTTRTFCGTPDYIAPEIIAYQPYGKSVDWWAYGVLLYEMLAGQPPFDGEDEDELFQSIMEHNVSYPKSLSKEAVSICKGLMTKHPAKRLGCGPEGERDVREHAFFRRIDWEKLENREIQPPFKPKVCGKGAENFDKFFTRGQPVLTPPDQLVIANIDQSDFEGFSYVNPQFVHPILQSAV

SEQ ID NO: 34 - protein, 596 aa, Homo sapiens
MPTQRDSSTMSHTVAGGGSGDHSHQVRVKAYYRGDIMITHFEPSISFEGLCNEVRDMCSFDNEQLFTMKWIDEEGDPCTVSSQLELEEAFRLYELNKDSELLIHVFPCVPERPGMPCPGEDKSIYRRGARRWRKLYCANGHTFQAKRFNRRAHCAICTDRIWGLGRQGYKCINCKLLVHKKCHKLVTIECGRHSLPQEPVMPMDQSSMHSDHAQTVIPYNPSSHESLDQVGEEKEAMNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGFSVDWWALGVLMFEMMAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 35 - protein, 592 aa, Homo sapiens
MPSRTGPKMEGSGGRVRLKAHYGGDIFITSVDAATTFEELCEEVRDMCRLHQQHPLTLKWVDSEGDPCTVSSQMELEEAFRLARQCRDEGLIIHVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 36 - protein, 721 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNVSLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 37 - protein, 143 aa, Homo sapiens
MPKVKRSRKAPPDGWELIEPTLDELDQKMREAETEPHEGKRKVESLWPIFRIHHQKTRYIFDLFYKRKAISRELYEYCIKEGYADKNLIAKWKKQGYENLCCLRCIQTRDTNFGTNCICRVPKSKLEVGRIIECTHCGCRGCS

SEQ ID NO: 38 - protein, 198 aa, Homo sapiens
MSNVRVSNGSPSLERMDARQAEHPKPSACRNLFGPVDHEELTRDLEKHCRDMEEASQRKWNFDFQNHKPLEGKYEWQEVEKGSLPEFYYRPPRPPKGACKVPAQESQDVSGSRPAAPLIGAPANSEDTHLVDPKTDPSDSQTGLAEQCAGIRKRPATDDSSTQNKRANRTEENVSDGSPNAGSVEQTPKKPGLRRRQT

SEQ ID NO: 39 - protein, 102 aa, Homo sapiens
MSSPPEGKLETKAGHPPAVKAGGMRIVQKHPHTGDTKEEKDKDDQEWESPSPPKPTVFISGVIARGDKDFPPAAAQVAHQKPHASMDKHPSPRTQHIQQPRK

SEQ ID NO: 40 - protein, 369 aa, Homo sapiens
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPVSSPTRSRSPSRSPSPTFSWLPLKTSPPSSPKAASASISSMSEGDEDEK

SEQ ID NO: 41 - protein, 100 aa, Homo sapiens
MPKRKVSSAEGAAKEEPKRRSARLSAKPPAKVEAKPKKAAAKDKSSDKKVQTKGKRGAKGKQAEVANQETKEDLPAENGETKTEESPASDEAGEKEAKSD

SEQ ID NO: 42 - protein, 603 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 43 - protein, 822 aa, Homo sapiens
MGFGSDLKNSHEAVLKLQDWELRLLETVKKFMALRIKSDKEYASTLQNLCNQVDKESTVQMNYVSNVSKSWLLMIQQTEQLSRIMKTHAEDLNSGPLHRLTMMIKDKQQVKKSYIGVHQQIEAEMIKVTKTELEKLKCSYRQLIKEMNSAKEKYKEALAKGKETEKAKERYDKATMKLHMLHNQYVLALKGAQLHQNQYYDITLPLLLDSLQKMQEEMIKALKGIFDEYSQITSLVTEEIVNVHKEIQMSVEQIDPSTEYNNFIDVHRTTAAKEQEIEFDTSLLEENENLQANEIMWNNLTAESLQVMLKTLAEELMQTQQMLLNKEEAVLELEKRIEESSETCEKKSDIVLLLSQKQALEELKQSVQQLRCTEAKFSAQKELLEQKVQENDGKEPPPVVNYEEDARSVTSMERKERLSKFESIRHSIAGIIRSPKSAVGSSALSDMISISEKPLAEQDWYHGAIPRIEAQELLKKQGDFLVRESHGKPGEYVLSVYSDGQRRHFIIQYVDNMYRFEGTGFSNIPQLIDHHYTTKQVITKKSGVVLLNPIPKDKKWILSHEDVILGELLGKGNFGEVYKGTLKDKTSVAVKTCKEDLPQELKIKFLQEAKILKQYDHPNIVKLIGVCTQRQPVYIIMELVSGGDFLTFLRRKKDELKLKQLVKFSLDAAAGMLYLESKNCIHRDLAARNCLVGENNVLKISDFGMSRQEDGGVYSSSGLKQIPIKWTAPEALNYGRYSSESDVWSFGILLWETFSLGVCPYPGMTNQQAREQVERGYRMSAPQHCPEDISKIMMKCWDYKPENRPKFSELQKELTIIKRKLT

SEQ ID NO: 44 - protein, 213 aa, Homo sapiens
MAQETNQTPGPMLCSTGCGFYGNPRTNGMCSVCYKEHLQRQQNSGRMSPMGTASGSNSPTSDSASVQRADTSLNNCEGAAGSTSEKSRNVPVAALPVTQQMTEMSISREDKITTPKTEVSEPVVTQPSPSVSQPSTSQSEEKAPELPKPKKNRCFMCRKKVGLTGFDCRCGNLFCGLHRYSDKHNCPYDYKAEAAAKIRKENPVVVAEKIQRI

SEQ ID NO: 45 - protein, 1068 aa, Homo sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 46 - protein, 112 aa, Homo sapiens
MSAEVPEAASAEEQKEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 47 - protein, 543 aa, Homo sapiens
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 48 - protein, 463 aa, Homo sapiens
MGWITEDLIRRNAEHNDCVIFSLEELSLHQQEIERLEHIDKWCRDLKILYLQNNLIGKIENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDIEEHNTKKLDDDLEFWNKPCLFTPESRLETLRHMEKQRKKQEKLSEKKKKVKPPRTLITEDGKALNVNEPKIDFSLKDNEKQIILDLAVYRYMDTSLIDVDVQPTYVRVMIKGKPFQLVLPAEVKPDSSSAKRSQTTGHLVICMPKVGEVITGGQRAFKSMKTTSDRSREQTNTRSKHMEKLEVDPSKHSFPDVTNIVQEKKHTPRRRPEPKIIPSEEDPTFEDNPEVPPLI

SEQ ID NO: 49 - protein, 676 aa, Homo sapiens
MDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEGSDETIRVVSMDRDYHVECYHCEDCGLELNDEDGHRCYPLEDHLFCHSCHVKRLEKRPSSTALHQHHF

SEQ ID NO: 50 - protein, 113 aa, Homo sapiens
MADVEDGEETCALASHSGSSGSKSGGDKMFSLKKWNAVAMWSWDVECDTCAICRVQVMDACLRCQAENKQEDCVVVWGECNHSFHNCCMSLWVKQNNRCPLCQQDWVVQRIGK

SEQ ID NO: 51 - protein, 153 aa, Homo sapiens
MTSESTSPPVVPPLHSPKSPVWPTFPFHREGSRVWERGGVPPRDLPSPLPTKRTRTYSATARASAGPVFKGVCKQFSRSQGHGFITPENGSEDIFVHVSDIEGEYVPVEGDEVTYKMCPIPPKNQKFQAVEVVLTQLAPHTPHETWSGQVVGS

SEQ ID NO: 52 - protein, 786 aa, Homo sapiens
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHRCFSFGIGEGTSTSLIKGIARASGGTSEFITGKDRMQSKALRTLKRSLQPVVEDVSLSWHLPPGLSAKMLSPEQTVIFRGQRLISYAQLTGRMPAAETTGEVCLKYTLQGKTFEDKVTFPLQPKPDVNLTIHRLAAKSLLQTKDMGLRETPASDKKDALNLSLESGVISSFTAFIAINKELNKPVQGPLAHRDVPRPILLGASAPLKIKCQSGFRKALHSDRPPSASQPRGELMCYKAKTFQMDDYSLCGLISHKDQHSPGFGENHLVQLIYHQNANGSWDLNEDLAKILGMSLEEIMAAQPAELVDSSGWATILAVIWLHSNGKDLKCEWELLERKAVAWMRAHAGSTMPSVVKAAITFLKSSVDPAIFAF

SEQ ID NO: 53 - protein, 181 aa, Homo sapiens
MPKGGRKGGHKGRARQYTSPEEIDAQLQAEKQKAREEEEQKEGGDGAAGDPKKEKKSLDSDESEDEEDDYQQKRKGVEGLIDIENPNRVAQTTKKVTQLDLDGPKELSRREREEIEKQKAKERYMKMHLAGKTEQAKADLARLAIIRKQREEAARKKEEERKAKDDATLSGKRMQSLSLNK

SEQ ID NO: 54 - protein, 837 aa, Homo sapiens
MASKRKSTTPCMVRTSQVVEQDVPEEVDRAKEKGIGTPQPDVAKDSWAAELENSSKENEVIEVKSMGESQSKKLQGGYECKYCPYSTQNLNEFTEHVDMQHPNVILNPLYVCAECNFTTKKYDSLSDHNSKFHPGEANFKLKLIKRNNQTVLEQSIETTNHVVSITTSGPGTGDSDSGISVSKTPIMKPGKPKADAKKVPKKPEEITPENHVEGTARLVTDTAEILSRLGGVELLQDTLGHVMPSVQLPPNINLVPKVPVPLNTTKYNSALDTNATMINSFNKFPYPTQAELSWLTAASKHPEEHIRIWFATQRLKHGISWSPEEVEEARKKMFNGTIQSVPPTITVLPAQLAPTKVTQPILQTALPCQILGQTSLVLTQVTSGSTTVSCSPITLAVAGVTNHGQKRPLVTPQAAPEPKRPHIAQVPEPPPKVANPPLTPASDRKKTKEQIAHLKASFLQSQFPDDAEVYRLIEVTGLARSEIKKWFSDHRYRCQRGIVHITSESLAKDQLAIAASRHGRTYHAYPDFAPQKFKEKTQGQVKILEDSFLKSSFPTQAELDRLRVETKLSRREIDSWFSERRKLRDSMEQAVLDSMGSGKKGQDVGAPNGALSRLDQLSGAQLTSSLPSPSPAIAKSQEQVHLLRSTFARTQWPTPQEYDQLAAKTGLVRTEIVRWFKENRCLLKTGTVKWMEQYQHQPMADDHGYDAVARKATKPMAESPKNGGDVVPQYYKDPKKLCEEDLEKLVTRVKVGSEPAKDCLPAKPSEATSDRSEGSSRDGQGSDENEESSVVDYVEVTVGEEDAISDRSDSWSQAAAEGVSELAESDSDCVPAEAGQA

SEQ ID NO: 55 - protein, 803 aa, Homo sapiens
MEVKPVGEPTQEVSKFKLSTKVESTGHWLVEDHVRIWEVLKTEESSIQDWGEEVEEGAVYHVTLKRVQIQQAANKGARWLGVEGDQLPPGHTVSQYETCKIRTIKAGTLEKLVENLLTAFGDNDFTYISIFLSTYRGFASTKEVLELLLDRYGNLTSPNCEEDGSQSSSESKMVIRNAIASILRAWLDQCAEDFREPPHFPCLQKLLDYLTRMMPGSDPERRAQNLLEQFQKQEVETDNGLPNTISFSLEEEEELEGGESAEFTCFSEDLVAEQLTYMDAQLFKKVVPHHCLGCIWSRRDKKENKHLAPTIRATISQFNTLTKCVVSTILGGKELKTQQRAKIIEKWINIAHECRLLKNFSSLRAIVSALQSNSIYRLKKTWAAVPRDRMLMFEELSDIFSDHNNHLTSRELLMKEGTSKFANLDSSVKENQKRTQRRLQLQKDMGVMQGTVPYLGTFLTDLTMLDTALQDYIEGGLINFEKRRREFEVIAQIKLLQSACNSYCMTPDQKFIQWFQRQQLLTEEESYALSCEIEAAADASTTSPKPRKSMVKRLSLLFLGSDMITSPTPTKEQPKSTASGSSGESMDSVSVSSCESNHSEAEEGSITPMDTPDEPQKKLSESSSSCSSIHSMDTNSSGMSSLINPLSSPPSCNNNPKIHKRSVSVTSITSTVLPPVYNQQNEDTCIIRISVEDNNGNMYKSIMLTSQDKTPAVIQRAMLKHNLDSDPAEEYELVQVISEDKELVIPDSANVFYAMNSQVNFDFILRKKNSMEEQVKLRSRTSLTLPRTAKRGCWSYRHSKITL

SEQ ID NO: 56 - protein, 162 aa, Homo sapiens
MASSVDEEALHQLYLWVDNIPLSRPKRNLSRDFSDGVLVAEVIKFYFPKMVEMHNYVPANSLQQKLSNWGHLNRKVLKRLNFSVPDDVMRKIAQCAPGVVELVLIPLRQRLEERQRRRKQGAGSLQELAPQDGSGYMDVGKVAFSISPSRLELSFCPSSCHL

SEQ ID NO: 57 - protein, 275 aa, Homo sapiens
MATELEYESVLCVKPDVSVYRIPPRASNRGYRASDWKLDQPDWTGRLRITSKGKTAYIKLEDKVSGELFAQAPVEQYPGIAVETVTDSSRYFVIRIQDGTGRSAFIGIGFTDRGDAFDFNVSLQDHFKWVKQESEISKESQEMDARPKLDLGFKEGQTIKLCIGNITNKKGGASKPRTARGGGLSLLPPPPGGKVTIPPPSSSVAISNHVTPPPIPKSNHGGSDADILLDLDSPAPVTTPAPTPVSVSNDLWGDFSTASSSVPNQAPQPSNWVQF

SEQ ID NO: 58 - protein, 76 aa, Homo sapiens
MARGQQKIQSQQKNAKKQAGQKKKQGHDQKAAAKAALIYTCTVCRTQMPDPKTFKQHFESKHPKTPLPPELADVQA

SEQ ID NO: 59 - protein, 289 aa, Homo sapiens
MPVVRKIFRRRRGDSESEEDEQDSEEVRLKLEETREVQNLRKRPNGVSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAPIRRNKEEPKARPLRVGDTEKPEPERSPPNRKRPANEKATDDYHYEKFKKMNRRY

SEQ ID NO: 60 - protein, 153 aa, Homo sapiens
MPYVFSFKMPQEQGQMFQYYPVYMVLPWEQPQQTVPRSPQQTRQQQYEEQIPFYAQFGYIPQLAEPAISGGQQQLAFDPQLGTAPEIAVMSTGEEIPYLQKEAINFRHDSAGVFMPSTSPKPSTTNVFTSAVDQTITPELPEEKDKTDSLREP

SEQ ID NO: 61 - protein, 386 aa, Homo sapiens
MTSLFRRSSSGSGGGGTAGARGGGGGTAAPQELNNSRPARQVRRLEFNQAMDDFKTMFPNMDYDIIECVLRANSGAVDATIDQLLQMNLEGGGSSGGVYEDSSDSEDSIPPEILERTLEPDSSDEEPPPVYSPPAYHMHVFDRPYPLAPPTPPPRIDALGSGAPTSQRRYRNWNPPLLGNLPDDFLRILPQQLDSIQGNAGGPKPGSGEGCPPAMAGPGPGDQESRWKQYLEDERIALFLQNEEFMKELQRNRDFLLALERDRLKYESQKSKSSSVAVGNDFGFSSPVPGTGDANPAVSEDALFRDKLKHMGKSTRRKLFELARAFSEKTKMRKSKRKHLLKHQSLGAAASTANLLDDVEGHACDEDFRGRRQEAPKVEEGLREGQ

SEQ ID NO: 62 - protein, 329 aa, Homo sapiens
MAAQYGSMSFNPSTPGASYGPGRQEPRNSQLRIVLVGKTGAGKSATGNSILGRKVFHSGTAAKSITKKCEKRSSSWKETELVVVDTPGIFDTEVPNAETSKEIIRCILLTSPGPHALLLVVPLGRYTEEEHKATEKILKMFGERARSFMILIFTRKDDLGDTNLHDYLREAPEDIQDLMDIFGDRYCALNNKATGAEQEAQRAQLLGLIQRVVRENKEGCYTNRMYQRAEEEIQKQTQAMQELHRVELEREKARIREEYEEKIRKLEDKVEQEKRKKQMEKKLAEQEAHYAVRQQRARTEVESKDGILELIMTALQIASFILLRLFAED

SEQ ID NO: 63 - protein, 78 aa, Homo sapiens
MSEVLPYGDEKLSPYGDGGDVGQIFSCRLQDTNNFFGAGQNKRPPKLGQIGRSKRVVIEDDRIDDVLKNMTDKAPPGV

SEQ ID NO: 64 - protein, 686 aa, Homo sapiens
MKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGRHPGGGDYEEL

SEQ ID NO: 65 - protein, 376 aa, Homo sapiens
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSAENNSLDTDDHFKPSPWPRSMLKKKSHMEEKDGLEDKETALSEELELHSAPSSLPTPNGIQLEAEKKAFSENLDPEDSCLTSLASSSLKQILGDSFSPGSEGNASGKDPNEEITENHNSLKSDENKENSFSADHVTTAVEKSKESQVTADDLEEEKAKAELIMDDDRTVDPLLSKSQSILISTSATASSKKTIEDRNIKNKKSTNNRASSASARSG

SEQ ID NO: 66 - protein, 441 aa, Homo sapiens
MKKFFQEFKADIKFKSAGPGQKLKESVGEKAHKEKPNQPAPRPPRQGPTNEAQMAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 67 - protein, 204 aa, Homo sapiens
MEAAGSPAATETGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 68 - protein, 190 aa, Homo sapiens
MASRGKTETSKLKQNLEEQLDRLMQQLQDLEECREELDTDEYEETKKETLEQLSEFNDSLKKIMSGNMTLVDELSGMQLAIQAAISQAFKTPEVIRLFAKKQPGQLRTRLAEMDRDLMVGKLERDLYTQQKVEILTALRKLGEKLTADDEAFLSANAGAILSQFEKVSTDLGSGDKILALASFEVEKTKK

SEQ ID NO: 69 - protein, 194 aa, Homo sapiens
MAPKKDVKKPVAAAAAAPAPAPAPAPAPAPAKPKEEKIDLSAIKIEFSKEQQDEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEKMKEEEVEALMAGQEDSNGCINYEAFVKHIMSI

SEQ ID NO: 70 - protein, 227 aa, Homo sapiens
MEKLFNENEGMPSNQGKIDNEEQPPHEGKPEVACILEDKKLENEGNTENTGKRVEEPLKDKEKPESAGKAKGEGKSERKGKSEMQGGSKTEGKPERGGRAEGEGEPDSEREPESEGEPESETRAAGKRPAEDDIPRKAKRKTNKGLAQYLKQYKEAIHDMNFSNEDMIREFDNMARVEDKRRKSKQKLGAFLWMQRNLQDPFYPRGPREFRGGCRAPRRDTEDIPYV

SEQ ID NO: 71 - protein, 109 aa, Homo sapiens
MAKQPSDVSSECDREGRQLQPAERPPQLRPGAPTSLQTEPQDRSPAPMSCDKSTQTPSPPCQAFNHYLSAMASMRQAEPADMRPEIWIAQELRRIGDEFNAYYARRLEK

SEQ ID NO: 72 - protein, 363 aa, Homo sapiens
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKGTIT

SEQ ID NO: 73 - protein, 182 aa, Homo sapiens
MADSENQGPAEPSQAAAAAEAAAEEVMAEGGAQGGDCDSAAGDPDSAAGQMAEEPQTPAENAPKPKNDFIESLPNSVKCRVLALKKLQKRCDKIEAKFDKEFQALEKKYNDIYKPLLAKIQELTGEMEGCAWTLEGEEEEEEEYEDDEEEGEDEEEEEAAAEAAAGAKHDDAHAEMPDDAKK

SEQ ID NO: 74 - protein, 365 aa, Homo sapiens
MDGPAEPQIPGLWDTYEDDISEISQKLPGEYFRYKGVPFPVGLYSLESISLAENTQDVRDDDIFIITYPKSGTTWMIEIICLILKEGDPSWIRSVPIWERAPWCETIVGAFSLPDQYSPRLMSSHLPIQIFTKAFFSSKAKVIYMGRNPRDVVVSLYHYSKIAGQLKDPGTPDQFLRDFLKGEVQFGSWFDHIKGWLRMKGKDNFLFITYEELQQDLQGSVERICGFLGRPLGKEALGSVVAHSTFSAMKANTMSNYTLLPPSLLDHRRGAFLRKGVCGDWKNHFTVAQSEAFDRAYRKQMRGMPTFPWDEDPEEDGSPDPEPSPEPEPKPSLEPNTSLEREPRPNSSPSPSPGQASETPHPRPS

SEQ ID NO: 75 - protein, 377 aa, Homo sapiens
MHDEVAQPLNLSAKPKTSDGKSPTSPTSPHMPALRINSGAGPLKASVPAALASPSARVSTIGYLNDHDAVTKAIQEARQMKEQLRREQQVLDGKVAVVNSLGLNNCRTEKEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 76 - protein, 307 aa, Homo sapiens
MSKRKLIPKLSIQSPVLHTNLNVQSTHPPLKKEDLHRISKDSLESDSESLTQEIMCHSEFDDRIRGNGMEPDSLDEEESPRWGSLHEMEEEASGKAAQMAREQNHHTWDQGANNRQQPIEDKYSDLRYDPNWKSKKEEGQLLSVEALPESTDSSLENLPLAPLYPSQETSMELSGGKGEQKESPQSAASLLGSEFLSPNYEHGARRSKPFSELSDSDLEEKSSSLSPYVKSSSSHNEVFLPGSRGPRRRKSKQHFVEKNKLTLGLPTPKTDSYLQLHNKKRGESHPEQVILRVNSLPRDGFKTFWSQ

SEQ ID NO: 77 - protein, 107 aa, Homo sapiens
MDAILNYRSEDTEDYYTLLGCDELSSVEQILAEFKVRALECHPDKHPENPKAVETFQKLQKAKEILTNEESRARYDHWRRSQMSMPFQQWEALNDSVKTVGFSLGAT

SEQ ID NO: 78 - protein, 486 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 79 - protein, 82 aa, Homo sapiens
MSQAGAQEAPIKKKRPPVKEEDLKGARGNLTKNQEIKSKTYQVMRECEQAGSAAPSVFSRTRTGTETVFEKPKAGPTKSVFG

SEQ ID NO: 80 - protein, 129 aa, Homo sapiens
MEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 81 - protein, 599 aa, Homo sapiens
MGPKRRQLTFREKSRIIQEVEENPDLRKGEIARRFNIPPSTLSTILKNKRAILASERKYGVASTCRKTNKLSPYDKLEGLLIAWFQQIRAAGLPVKGIILKEKALRIAEELGMDDFTASNGWLDRFRRRHGVVSCSGVARARARNAAPRTPAAPASPAAVPSEGSGGSTTGWRAREEQPPSVAEGYASQDVFSATETSLWYDFLPDQAAGLCGGDGRPRQATQRLSVLLCANADGSEKLPPLVAGKSAKPRAGQAGLPCDYTANSKGGVTTQALAKYLKALDTRMAAESRRVLLLAGRLAAQSLDTSGLRHVQLAFFPPGTVHPLERGVVQQVKGHYRQAMLLKAMAALEGQDPSGLQLGLTEALHFVAAAWQAVEPSDIAACFREAGFGGGPNATITTSLKSEGEEEEEEEEEEEEEEGEGEEEEEEGEEEEEEGGEGEELGEEEEVEEEGDVDSDEEEEEDEESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQAGVRGLGHQS

SEQ ID NO: 82 - protein, 453 aa, Homo sapiens
KKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLHEQDLNKRLEKELDVMTADHLREKNIMRADFNKTNELLKEINAALQVSLEEMEEKYLMRESKPEDIQMITELKAMLTERDQIIKKLIEDNKFYQLELVNRETNFNKVFNSSPTVGVINPLAKQKKKNDKSPTNRFVSVPNLSALESGGVGNGHPNRLDPIPNSPVHDIEFNSSKPLPQPVPPKGPKTFLSPAQSEASPVASPDPQRQEWFARYFTF

SEQ ID NO: 83 - protein, 287 aa, Homo sapiens
MEVMEGPLNLAHQQSRRADRLLAAGKYEEAISCHKKAAAYLSEAMKLTQSEQAHLSLELQRDSHMKQLLLIQERWKRAQREERLKAQQNTDKDAAAHLQTSHKPSAEDAEGQSPLSQKYSPSTEKCLPEIQGIFDRDPDTLLYLLQQKSEPAEPCIGSKAPKDDKTIIEEQATKIADLKRHVEFLVAENERLRKENKQLKAEKARLLKGPIEKELDVDADFVETSELWSLPPHAETATASSTWQKFAANTGKAKDIPIPNLPPLDFPSPELPLMELSEDILKGFMNN

SEQ ID NO: 84 - protein, 138 aa, Homo sapiens
MAELQQLRVQEAVESMVKSLERENIRKMQGLMFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGK

SEQ ID NO: 85 - protein, 349 aa, Homo sapiens
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVLTSTIKNEVDSTVNIIVVGQSHLDSNIENQEIVTNPPDICQVVEVTTESDEQPVSMSELYPLQISPVSSYAESETTDSVPSDEESAEGRPHWRKRNIEGKQYLSNMGTRGSYLLPGMASFVTSNKPDLQVTIKEESNPVPYNSSWPPFQDLPLSSSMTPASSSSRPDRETRASVIKKTSDITQARVKSC

SEQ ID NO: 86 - protein, 352 aa, Homo sapiens
MVRPVRHKKPVNYSQFDHSDSDDDFVSATVPLNKKSRTAPKELKQDKPKPNLNNLRKEEIPVQEKTPKKRLPEGTFSIPASAVPCTKMALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFCESEDNDEDFSMRKSKVKEIKKKEVKVKSPVEKKEKKSKSKCNALVTSVDSAPAAVKSESQSLPKKVSLSSDTTRKPLEIRSPSAESKKPKWVPPAASGGSRSSSSPLVVVSVKSPNQSLRLGLSRLARVKPLHPNATST

SEQ ID NO: 87 - protein, 413 aa, Homo sapiens [sequence omitted]

SEQ ID NO: 88 - protein, 109 aa, Homo sapiens
MEPNSPKKIQFAVPVFQSQIAPEAAEQIRKRRPTPASLVILNEHNPPEIDDKRGPNTQGELQNASPKQRKQSVYTPPTIKGVKHLKGQNESAFPEEEEGTNEREEQRDH

SEQ ID NO: 89 - protein, 259 aa, Homo sapiens
MLESSGCKALKEGVLEKRSDGLLQLWKKKCCILTEEGLLLIPPKQLQHQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQLQPQPQPQPQPQPQPQSQPQPQPQPKPQPQQLHPYPHPHPHPHSHPHSHPHPHPHPHPHQIPHPHPQPHSQPHGHRLLRSTSNSA

SEQ ID NO: 90 - protein, 743 aa, Homo sapiens
MGHREIVEHLLDHGAEVNHEDVDGRTALSVAALCVPASKGHASVVSLLIDRGAEVDHCDKDGMTPLLVAAYEGHVDVVDLLLEGGADVDHTDNNGRTPLLAAASMGHASVVNTLLFWGAAVDSIDSEGRTVLSIASAQGNVEVVRTLLDRGLDENHRDDAGWTPLHMAAFEGHRLICEALIEQGARTNEIDNDGRIPFILASQEGHYDCVQILLENKSNIDQRGYDGRNALRVAALEGHRDIVELLFSHGADVNCKDADGRPTLYILALENQLTMAEYFLENGANVEASDAEGRTALHVSCWQGHMEMVQVLIAYHADVNAADNEKRSALQSAAWQGHVKVVQLLIEHGAVVDHTCNQGATALCIAAQEGHIDVVQVLLEHGADPNHADQFGRTAMRVAAKNGHSQIIKLLEKYGASSLNGCSPSPVHTMEQKPLQSLSSKVQSLTIKSNSSGSTGGGDMQPSLRGLPNGPTHAFSSPSESPDSTVDRQKSSLSNNSLKSSKNSSLRTTSSTATAQTVPIDSFHNLSFTEQIQQHSLPRSRSRQSIVSPSSTTQSLGQSHNSPSSEFEWSQVKPSLKSTKASKGGKSENSAKSGSAGKKAKQSNSSQPKVLEYEMTQFDRRGPIAKSGTAAPPKQMPAESQCKIMIPSAQQEIGRSQQQFLIHQQSGEQKKRNGIMTNPNYHLQSNQVFLGRVSVPRTMQDRGHQEVLEGYPSSETELSLKQALKLQIEGSDPSFNYKKETPL

SEQ ID NO: 91 - protein, 373 aa, Homo sapiens
MLKRKPSNVSEKEKHQKPKRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 92 - protein, 190 aa, Homo sapiens
MPQSFSAITLSNTEMNNIKTNAQRNKLPIEELGKVSKHKIATKRTPHKEDEAMSCSENCSSAQGDSFQDESQGSHSESSSNPSNPETLHAKATDSVLQGSEGNKVKRTSCMYGANCYRKNPVHFQHFSHPGDSDYGGVQIVGQDETDDRPECPYGPSCYRKNPQHKIEYRHNTLPEADSAHNISAHRMRK

SEQ ID NO: 93 - protein, 430 aa, Homo sapiens
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 94 - protein, 294 aa, Homo sapiens
MASPGKPGADEAQEEEGELEGGSAGPRAAILEQAEELFLLCDKEAKGFITKHDLQGLQSDLPLTPEQLEAVFESLDQAHTGFLTAREFCLGLGMFVGVASAQGANPCRTPEETFESGGLDVQGTAGSLDEEEEEEERFHTVLEQLGVAPVLGEQRAVRTLWARLQRERPELLGSFEDVLIRASACLEEAARERDGLEQALRRRESEHEREVRALYEETEQLREQSRRPPSQNFARGERRSRLELELQIREQDLERAGLRQRERRGRRLQEHAERESQPATATGAAQGAEYTAAG

SEQ ID NO: 95 - protein, 506 aa, Homo sapiens [sequence omitted]

SEQ ID NO: 96 - protein, 766 aa, Homo sapiens
YPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 97 - protein, 265 aa, Homo sapiens
MAEAGTGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSLAAPTDCVSSFNQDPSSCGEGRVIFTKPVRGVEARHERKRVLGKVGEPGRGGLGNPATDRGEGPVELAHLAGPGSPEAEEWGSPHGGLQEVEALSGSVHSGSVPGLPPVETVGFHGSRKRSRDHFRNKSSSPEDPGAEV

SEQ ID NO: 98 - protein, 236 aa, Homo sapiens
MDMRVPAQLLGLLLLWLRGARCDIQMTQSPSSLSASVGDRVIITCRASQSISSYLNWYQQTPGKAPRILIYATSSLQSGVPARFSGSGSGTDFTLTISSLQPEDFATYYCQQSYSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 99 - protein, 148 aa, Homo sapiens
MEPEAFEICPYDPHHRIPLSRFQYHLASCRRKNPKKAKKMATCKYNACHVVPIKNLEEHEAVCVNRSAVEEEDTENPLKVSPPSSEQNDDTQQVSPCLPSPDIWNVDGANCQHVFVLKTFFPQKVVCENDTKESARETSPQKILRPGQ

SEQ ID NO: 100 - protein, 410 aa, Homo sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDSHM

SEQ ID NO: 101 - protein, 321 aa, Homo sapiens
MRRSSGFGGQKGQGPSCSFTGCWCCRGDDVAESDDSPFAQCGYNIQEKHLGKLHRAASRGEVSKVECILSSGSADLDERDKKKRTALHLACANGHPEVVALLVDRGCQLDVFDNKNRTALLKAVQCQEEECATILLEHGADPDLPDVYGNTTLHYAIYNEDIPMTKKLLLHHANIESANKDELTPFLLAVHEQKQQMEDFLRKQKENLTAVKLESIHQVMSEYKENETPRNPQNSNPEGTSNKMACLGEGAAGAKVDEIPGNPVTRLFNKPSIDDSRPMSANEDFDFDTEEKATEPANGKRQNGMGIIESAPQEHTNNENI

SEQ ID NO: 102 - protein, 141 aa, Homo sapiens
MEQPTSSTNGEKTKSPCESNNKKNDEMQEVPNRVLAPEQSLKKTKTSEYPIIFVYYLRKGKKINSNQLENEQSQENSINPIQKEEDEGVDLSEGSSNEDEDLGPCEGPSKEDKDLDSSEGSSQEDEDLGLSEGSSQDSGED

SEQ ID NO: 103 - protein, 454 aa, Homo sapiens
MSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLKPENIMLLDKNVPNPRIKLIDFGIAHKIEAGNEFKNIFGTPEFVAPEIVNYEPLGLEADMWSIGVITYILLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 104 - protein, 577 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 105 - protein, 506 aa, Homo sapiens
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTNPSRIRIALGNEASTVQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 106 - protein, 475 aa, Homo sapiens [sequence omitted]

SEQ ID NO: 107 - protein, 254 aa, Homo sapiens
MDPAASSCMRSLQPPAPVWGCLRNPHSEGNGASGLPHYPPTPFSFHQKPDFLATATAAYPDFSASCLAATPHSLPQEEHIFTEQHPAFPQSPNWHFPVSDARRRPNSGPAGGSKEMGTSSLGLVDTTGGPGDDYGVLGSTANETEKKSSRRRKESSDNQENRGKPEGSSKARKERTAFTKEQLRELEAEFAHHNYLTRLRRYEIAVNLDLSERQVKVWFQNRRMKWKRVKGGQPISPNGQDPEDGDSTASPSSE

SEQ ID NO: 108 - protein, 424 aa, Homo sapiens
EQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 109 - protein, 322 aa, Homo sapiens
MLAVHFDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGNVQAGDYVLIHAGLSGVGTAAIQLTRMAGAIPLVTAGSQKKLQMAEKLGAAAGFNYKKEDFSEATLKFTKGAGVNLILDCIGGSYWEKNVNCLALDGRWVLYGLMGGGDINGPLFSKLLFKRGSLITSLLRSRDNKYKQMLVNAFTEQILPHFSTEGPQRLLPVLDRIYPVTEIQEAHSTWRPTRT

SEQ ID NO: 110 - protein, 1094 aa, Homo sapiens
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 111 - protein, 737 aa, Homo sapiens
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYVIIDLSGSSGEAPKDNEERVFRERMRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 112 - protein, 834 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 113 - protein, 185 aa, Homo sapiens
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKPRGFARGLEPERIIGATDSSGELMFLMKWKNSDEADLVPAKEANVKCPQVVISFYEERLTWHSYPSEDDDKKDDKN

SEQ ID NO: 114 - protein, 392 aa, Homo sapiens
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTAAGLMHTFNAHAATDITGFGILGHAQNLAKQQRNEVSFVIHNLPVLAKMAAVSKACGNMFGLMHGTCPETSGGLLICLPREQAARFCAEIKSPKYGEGHQAWIIGIVEKGNRTARIIDKPRIIEVAPQVATQNVNPTPGATS

SEQ ID NO: 115 - protein, 268 aa, Homo sapiens
MAVNVYSTSVTSDNLSRHDMLAWINESLQLNLTKIEQLCSGAAYCQFMDMLFPGSIALKKVKFQAKLEHEYIQNFKILQAGFKRMGVDKIIPVDKLVKGKFQDNFEFVQWFKKFFDANYDGKDYDPVAARQGQETAVAPSLVAPALNKPKKPLTSSSAAPQRPISTQRTAAAPKAGPGVVRKNPGVGNGDDEAAELMQQVNVLKLTVEDLEKERDFYFGKLRNIELICQENEGENDPVLQRIVDILYATDEGFVIPDEGGPQEEQEEY

SEQ ID NO: 116 - protein, 889 aa, Homo sapiens
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPGPLDFEAYSAAALQEAMKRLRGAKAFRLPGLSRREREPEPPAAVDFLEPDSGTCPEVDEEGFTVRPDVTQNSTAEPSRFSSSDSDFDDEEPRKFYVHIKPAPARAPACSPEAAAAQLRATAGSLILPPGPGGTMKRHSSRDAAGKPQRPRSAPRTSSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATGMYLVSC

SEQ ID NO: 117 - protein, 552 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRCDLSAQGPEGREHGDGSARTLAGR

SEQ ID NO: 118 - protein, 138 aa, Homo sapiens
MEDLTNVSSLLNMERARDKANEEGLALLQEEIDKMVETTELMTGNIQSLKNKIQILASEVEEEEERVKQMHQINSSGVLSLPELSQKTLKAPTLQKEILALIPNQNALLKDLDILHNSSQMKSMSTFIEEAYKKLDAS

SEQ ID NO: 119 - protein, 491 aa, Homo sapiens
MAQSGGEARPGPKTAVQIRVAIQEAEDVDELEDEEEGAETRGAGDPARYLSPGWGSASEEEPSRGHSGTTASGGENEREDLEQEWKPPDEELIKKLVDQIEFYFSDENLEKDAFLLKHVRRNKLGYVSVKLLTSFKKVKHLTRDWRTTAHALKYSVVLELNEDHRKVRRTTPVPLFPNENLPSKMLLVYDLYLSPKLWALATPQKNGRVQEKVMEHLLKLFGTFGVISSVRILKPGRELPPDIRRISSRYSQVGTQECAIVEFEEVEAAIKAHEFMITESQGKENMKAVLIGMKPPKKKPAKDKNHDEEPTASIHLNKSLNKRVEELQYMGDESSANSSSDPESNPTSPMAGRRHAATNKLSPSGHQNLFLSPNASPCTSPWSSPLAQRKGVSRKSPLAEEGRLNCSTSPEIFRKCMDYSSDSSVTPSGSPWVRRRRQAEMGTQEKSPGTSPLLSRKMQTADGLPVGVLRLPRGPDNTRGFHGHERSRACV

SEQ ID NO: 120 - protein, 225 aa, Homo sapiens
MSTVVELNVGGEFHTTTLGTLRKFPGSKLAEMFSSLAKASTDAEGRFFIDRPSTYFRPILDYLRTGQVPTQHIPEVYREAQFYEIKPLVKLLEDMPQIFGEQVSRKQFLLQVPGYSENLELMVRLARAEAITARKSSVLVCLVETEEQDAYYSEVLCFLQDKKMFKSVVKFGPWKAVLDNSDLMHCLEMDIKAQGYKVFSKFYLTYPTKRNEFHFNIYSFTFTWW

SEQ ID NO: 121 - protein, 343 aa, Homo sapiens
MEAVATATAAKEPDKGCIEPGPGHWGELSRTPVPSKPQDKVEAAEATPVALDSDTSGAENAAVSAMLHAVAASRLPVCSQQQGEPDLTEHEKVAILAQLYHEKPLVFLERFRTGLREEHLACFGHVRGDHRADFYCAEVARQGTARPRTLRTRLRNRRYAALRELIQGGEYFSDEQMRFRAPLLYEQYIGQYLTQEELSARTPTHQPPKPGSPGRPACPLSNLLLQSYEERELQQRLLQQQEEEEACLEEEEEEEDSDEEDQRSGKDSEAWVPDSEERLILREEFTSRMHQRFLDGKDGDFDYSTVDDNPDFDNLDIVARDEEERYFDEEEPEDAPSPELDGD

SEQ ID NO: 122 - protein, 513 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 123 - protein, 188 aa, Homo sapiens
MEVHGKPQASPSCSSPTRDSSGVPVSKELLTAGSDGRGGIWDRLLINSQPKSRKTSTLQTVRIERSPLLDQVQTFLPQMARANEKLRKEMAAAPPGRFNIENIDGPHSKVIQMDVALFEMNQSDSKEVDSSEESSQDSSENSSESEDEDDSIPSEVTIDNIKLPNSEGGKGKIEVLDSPASKKKEIVK

SEQ ID NO: 124 - protein, 796 aa, Homo sapiens
MRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGAGAVRPAVPTGGPPYPHAPYGAGRGNYDAFRGQGGYPGKPRNRMVRGDPRAIVEYRDLDAPDDVDFF

SEQ ID NO: 125 - protein, 317 aa, Homo sapien
MRKTSNSCIMENGHQPGTGPGDGPPEIAQNFSAPDPPRPRPVSLSLRLPHQPVTAITRVSDRFSGETSAAALSPMSAATLGGLNPSPSEVITPWTPSPSEKNSSFTWSVPSSGYGAVTASKHSNSPPLVTPPQSPVSPQPPAITQVHRQGERRRELVRSQTLPRTSEAQARKALFEKWEQETAAGKGKGEARARLKRSQSFGVASASSIKQILLEWCRSKTLGYQHVDLQNFSSSWSDGMAFCALVHSFFPDAFDYNSLSPTQRQKNFELAFTMAENLANCERLIEVEDMMVMGRKPDPMCVFTYVQSLYNHLRRFE

SEQ ID NO: 126 - protein, 251 aa, Homo sapiens
MYRVIQVSEGQLDGQTEGTGAISGYPATQSMTQAVIQGAFTSDDAVDTEGTAAETHYTYFPSTAVGDGAGGTTSGSTAAVVTTQGSEALLGQATPPGTGQFFVMMSPQEVLQGGSQRSIAPRTHPYSPKSEAPRTTRDEKRRAQHNEVERRRRDKINNWIVQLSKIIPDCSMESTKSGQSKGGILSKACDYIQELRQSNHRLSEELQGLDQLQLDNDVLRQQVEDLKNKNLLLRAQLRHHGLEVVIKNDSN

SEQ ID NO: 127 - protein, 83 aa, Homo sapiens
MHSTPANPVEAVVQRAGFVASQASLRPWKQDRRAGDPWPRTHEFGYPEASLQASACKKKKSKDKKRKREDEETQLDTLESGEQ

SEQ ID NO: 128 - protein, 675 aa, Homo sapiens
APFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 129 - protein, 380 aa, Homo sapiens
ASQRLRLPLPLRAAPARLSPAPAAPPRRDLGHRPAPRARGRPEPAPLPRRPRPPGPPRPQLPGGGKRWLGGTMADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEWR

SEQ ID NO: 130 - protein, 1620 aa, Homo sapiens [sequence omitted]

SEQ ID NO: 131 - protein, 198 aa, Homo sapiens; identical to SEQ ID NO: 38

SEQ ID NO: 132 - protein, 432 aa, Homo sapiens
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRETSLDTKSVSEGHLKRNIVVKTVEMRDGEVIKESKQEHKDVM

SEQ ID NO: 133 - protein, 483 aa, Homo sapiens
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 134 - protein, 885 aa, Homo sapiens [sequence omitted]

SEQ ID NO: 135 - protein, 225 aa, Homo sapiens [sequence omitted]

SEQ ID NO: 136 - protein, 658 aa, Homo sapiens
MNQPQRMAPVGTDKELSDLLDFSMMFPLPVTNGKGRPASLAGAQFGGSGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTRCQPTPRHSPPSPHQDAHVHRPHAHRTHTGRPSAGPTLFPQPHCLPLAPSRRPPHSPDEDEDDLLPPEQKAEREKERRVANNARERLRVRDINEAFKELGRMCQLHLNSEKPQTKLLILHQAVSVILNLEQQVRERNLNPKAACLKRREEEKVSGVVGDPQMVLSAPHPGLSEAHNPAGHM

SEQ ID NO: 137 - protein, 508 aa, Homo sapiens
MQGHFPAERREGRPRRGTRGQQQLLVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 138 - protein, 334 aa, Homo sapiens
MSQSKGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 139 - protein, 433 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKDSSGTGHFTSGVRVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 140 - protein, 400 aa, Homo sapiens [sequence omitted]

SEQ ID NO: 141 - protein, 152 aa, Homo sapiens
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 142 - protein, 505 aa, Homo sapiens
MSNICQRLWEYLEPYLPCLSTEADKSTVIENPGALCSPQSQRHGHYFVALFDYQARTAEDLSFRAGDKLQVLDTLHEGWWFARHLEKRRDGSSQQLQGYIPSNYVAEDRSLQAEPWFFGAIGRSDAEKQLLYSENKTGSFLIRESESQKGEFSLSVLDGAVVKHYRIKRLDEGGFFLTRRRIFSTLNEFVSHYTKTSDGLCVKLGKPCLKIQVPAPFDLSYKTVDQWEIDRNSIQLLKRLGSGQFGEVWEGLWNNTTPVAVKTLKPGSMDPNDFLREAQIMKNLRHPKLIQLYAVCTLEDPIYIITELMRHGSLQEYLQNDTGSKIHLTQQVDMAAQVASGMAYLESRNYIHRDLAARNVLVGEHNIYKVADFGLARVFKVDNEDIYESRHEIKLPVKWTAPEAIRSNKFSIKSDVWSFGILLYEIITYGKMPYSGMTGAQVIQMLAQNYRLPQPSNCPQQFYNIMLECWNAEPKERPTFETLRWKLEDYFETDSSYSDANNFIR

SEQ ID NO: 143 - protein, 505 aa, Homo sapiens
MGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 144 - protein, 346 aa, Homo sapiens
MGDPPKKKRLISLCVGCGNQIHDQYILRVSPDLEWHAACLKCAECNQYLDESCTCFVRDGKTYCKRDYIRLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTNIQGMTGTPMVAASPERHDGGLQANPVEVQSYQPPWKVLSDFALQSDIDQPAFQQLVNFSEGGPGSNSTGSEVASMSSQLPDTPNSMVASPIEA

SEQ ID NO: 145 - protein, 360 aa, Homo sapiens [sequence omitted]

SEQ ID NO: 146 - protein, 326 aa, Homo sapiens
MPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRPSSASPSGKPSGSAVNMGSVQGHYVQQAKQRVDEKPSLGAVKLQEAPSAASQMKRTGAIKPRAVKVEESKA

SEQ ID NO: 147 - protein, 202 aa, Homo sapiens
MGEPAGVAGTMESPFSPGLFHRLDEDWDSALFAELGYFTDTDELQLEAANETYENNFDNLDFDLDLVPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTISSIPPQT

SEQ ID NO: 148 - protein, 101 aa, Homo sapiens
MQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 149 - protein, 402 aa, Homo sapiens [sequence omitted]

SEQ ID NO: 150 - protein, 442 aa, Homo sapiens
MRGAMELEPELLLQEARENVEAAQSYRRELGHRLEGLREARRQIKESASQTRDVLKQHFNDLKGTLGKLLDERLVTLLQEVDTIEQETIKPLDDCQKLIEHGVNTAEDLVREGEIAMLGGVGEENEKLWSFTKKASHIQLDSLPEVPLLVDVPCLSAQLDDSILNIVKDHIFKHGTVASRPPVQIEELIEKPGGIIVRWCKVDDDFTAQDYRLQFRKCTSNHFEDVYVGSETEFIVLHIDPNVDYQFRVCARGDGRQEWSPWSVPQIGHSTLVPHEWTAGFEGYSLSSRRNIALRNDSESSGVLYSRAPTYFCGQTLTFRVETVGQPDRRDSIGVCAEKQDGYDSLQRDQAVCISTNGAVFVNGKEMTNQLPAVTSGSTVTFDIEAVTLGTTSNNEGGHFKLRVTISSNNREVVFDWLLDQSCGSLYFGCSFFYPGWKVLVF

SEQ ID NO: 151 - protein, 349 aa, Homo sapiens
MGDMGDPPKKKRLISLCVGCGNQIHDQYILRVSPDLEWHAACLKCAECNQYLDESCTCFVRDGKTYCKRDYIRLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTNIQGMTGTPMVAASPERHDGGLQANPVEVQSYQPPWKVLSDFALQSDIDQPAFQQLVNFSEGGPGSNSTGSEVASMSSQLPDTPNSMVASPIEA

SEQ ID NO: 152 - protein, 513 aa, Homo sapiens
MRPGLPGPTGLCAQTSSRGQKSVLKQKESCGIWQLYHFLSRKQEPRWEPCVSGSSSGDGAVADLADELRGYPALCCTLPVHSYRSWAGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRRAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 153 - protein, 234 aa, Homo sapiens [sequence omitted]

SEQ ID NO: 154 - protein, 340 aa, Homo sapiens
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMSRNSLQQGDVDGAQRLGRVAKLLSIVALVGGVLIIIASCVINLGVYK

SEQ ID NO: 155 - protein, 1242 aa, Homo sapiens
MASPPESDGFSDVRKVGYLRKPKSMHKRFFVLRAASEAGGPARLEYYENEKKWRHKSSAPKRSIPLESCFNINKRADSKNKHLVALYTRDEHFAIAADSEAEQDSWYQALLQLHNRAKGHHDGAAALGAGGGGGSCSGSSGLGEAGEDLSYGDVPPGPAFKEVWQVILKPKGLGQTKNLIGIYRLCLTSKTISFVKLNSEAAAVVLQLMNIRRCGHSENFFFIEVGRSAVTGPGEFWMQVDDSVVAQNMHETILEAMRAMSDEFRPRSKSQSSSNCSNPISVPLRRHHLNNPPPSQVGLTRRSRTESITATSPASMVGGKPGSFRVRASSDGEGTMSRPASVDGSPVSPSTNRTHAHRHRGSARLHPPLNHSRSIPMPASRCSPSATSPVSLSSSSTSGHGSTSDCLFPRRSSASVSGSPSDGGFISSDEYGSSPCDFRSSFRSVTPDSLGHTPPARGEEELSNYICMGGKGPSTLTAPNGHYILSRGGNGHRCTPGTGLGTSPALAGDEAASAADLDNRFRKRTHSAGTSPTITHQKTPSQSSVASIEEYTEMMPAYPPGGGSGGRLPGHRHSAFVPTRSYPEEGLEMHPLERRGGHHRPDSSTLHTDDGYMPMSPGVAPVPSGRKGSGDYMPMSPKSVSAPQQIINPIRRHPQRVDPNGYMMMSPSGGCSPDIGGGPSSSSSSSNAVPSGTSYGKLWTNGVGGHHSHVLPHPKPPVESSGGKLLPCTGDYMNMSPVGDSNTSSPSDCYYGPEDPQHKPVLSYYSLPRSFKHTQRPGEPEEGARHQHLRLSTSSGRLLYAATADDSSSSTSSDSLGGGYCGARLEPSLPHPHHQVLQPHLPRKVDTAAQTNSRLARPTRLSLGDPKASTLPRAREQQQQQQPLLHPPEPKSPGEYVNIEFGSDQSGYLSGPVAFHSSPSVRCPSQLQPAPREEETGTEEYMKMDLGPGRRAAWQESTGVEMGRLGPAPPGAASICRPTRAVPSSRGDYMTMQMSCPRQSYVDTSPAAPVSYADMRTGIAAEEVSLPRATMAAASSSSAASASPTGPQGAAELAAHSSLLGGPQGPGGMSAFTRVNLSPNRNQSAKVIRADPQGCRRRHSSETFSSTPSATRVGNTVPFGAGAAVGGGGGSSSSSEDVKRHSSASFENVWLRPGELGGAPKEPAKLCGAAGGLENGLNYIDLDLVKDFKQCPQECTPEPQPPPPPPPHQPLGSGESSSTRRSSEDLSAYASISFQKQPEDRQ

SEQ ID NO: 156 - protein, 521 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 157 - protein, 242 aa, Homo sapiens
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSGDQKVSRAGKNSKATKEEERSHSKKKLLTASDLAASDLKGFQPQIKDSSKEEVWKRRGGQGIPFKKQFLSQERAMCFSCPRNPFPAKPGSLTLPFHSEPAVWAQEV

SEQ ID NO: 158 - protein, 398 aa, Homo sapiens
MSDSTWMSADPHLASSLSPSQDERMRSPQNLHSQEDDDSSSESGSGNGSSTLNPSTSSSTQGDPAFPEMNGNGAVAPMDFTTAAEDQPINLCDKLPPATALGTASYPSDGCGADGLRSRVKYGVKTTPESPPYSSGSYDSIKTEVSGCPEDLTVGRAPTADDDDDDHDDHEDNDKMNDSEGMDPERLKAFNMFVRLFVDENLDRMVPISKQPKEKIQAIIESCSRQFPEFQERARKRIRTYLKSCRRMKKNGMEMTRPTPPHLTSAMAENILAAACESETRKAAKRMRLEIYQSSQDEPIALDKQHSRDSAAITHSTYSLPASSYSQDPVYANGGLNYSYRGYGALSSNLQPPASLQTGNHSNGPTDLSMKGGASTTSTTPSALSGEPPTRRWGCSSV

SEQ ID NO: 159 - protein, 461 aa, Homo sapiens
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELCVVCGDKATGYHYRCITCEGCKGFFRRTIQKNLHPSYSCKYEGKCVIDKVTRNQCQECRFKKCIYVGMATDLVLDDSKRLAKRKLIEENREKRRREELQKSIGHKPEPTDEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFDLGMSLSSFNLDDTEVALLQAVLLMSSDRPGLACVERIEKYQDSFLLAFEHYINYRKHHVTHFWPKLLMKVTDLRMIGACHASRFLHMKVECPTELFPPLFLEVFED

SEQ ID NO: 160 - protein, 1225 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 161 - protein, 881 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 162 - protein, 760 aa, Homo sapiens
MKEAALICLAPSVPPILTVKSWDTMQLRAARSRCTNLLAASYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 163 - protein, 457 aa, Homo sapiens
MEFLLGNPFSTPVGQCLEKATDGSLQSEDWTLNMEICDIINETEEGPKDAIRALKKRLNGNRNYREVMLALTAWADAFRSSPDLTGVVHIYEELKRKGVEFPMADLDALSPIHTPQRSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 164 - protein, 509 aa, Homo sapiens
MVDGVMILPVLIMIALPSPSMEDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLEVGLIILSVVFAVCLLACLLGVALRKFKRRNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRVDIWAFGLVLWEVARRMVSNGIVEDYKPPFYDVVPNDPSFEDMRKVVCVDQQRPNIPNRWFSDPTLTSLAKLMKECWYQNPSARLTALRIKKTLTKIDNSLDKLKTDC

SEQ ID NO: 165 - protein, 885 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 166 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 167 - protein, 346 aa, Homo sapiens
MALDVKSRAKRYEKLDFLGEGQFATVYKARDKNTNQIVAIKKIKLGHRSEAKDGINRTALREIKLLQELSHPNIIGLLDAFGHKSNISLVFDFMETDLEVIIKDNSLVLTPSHIKAYMLMTLQGLEYLHQHWILHRDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCSLPDYVTFKSFPGIPLHHIFSAAGDDLLDLIQGLFLFNPCARITATQALKMKYFSNRPGPTPGCQLPRPNCPVETLKEQSNPALAIKRKRTEALEQGGLPKKLIF

SEQ ID NO: 168 - protein, 505 aa, Homo sapiens; identical to SEQ ID NO: 142

SEQ ID NO: 169 - protein, 508 aa, Homo sapiens; identical to SEQ ID NO: 137

SEQ ID NO: 170 - protein, 954 aa, Homo sapiens
MEEEEGAVAKEWGTTPAGPVWTAVFDYEAAGDEELTLRRGDRVQVLSQDCAVSGDEGWWTGQLPSGRVGVFPSNYVAPGAPAAPAGLQLPQEIPFHELQLEEIIGVGGFGKVYRALWRGEEVAVKAARLDPEKDPAVTAEQVCQEARLFGALQHPNIIALRGACLNPPHLCLVMEYARGGALSRVLAGRRVPPHVLVNWAVQVARGMNYLHNDAPVPIIHRDLKSINILILEAIENHNLADTVLKITDFGLAREWHKTTKMSAAGTYAWMAPEVIRLSLFSKSSDVWSFGVLLWELLTGEVPYREIDALAVAYGVAMNKLTLPIPSTCPEPFARLLEECWDPDPHGRPDFGSILKRLEVIEQSALFQMPLESFHSLQEDWKLEIQHMFDDLRTKEKELRSREEELLRAAQEQRFQEEQLRRREQELAEREMDIVERELHLLMCQLSQEKPRVRKRKGNFKRSRLLKLREGGSHISLPSGFEHKITVQASPTLDKRKGSDGASPPASPSIIPRLRAIRLTPVDCGGSSSGSSSGGSGTWSRGGPPKKEELVGGKKKGRTWGPSSTLQKERVGGEERLKGLGEGSKQWSSSAPNLGKSPKHTPIAPGFASLNEMEEFAEAEDGGSSVPPSPYSTPSYLSVPLPAEPSPGARAPWEPTPSAPPARWGHGARRRCDLALLGCATLLGAVGLGADVAEARAADGEEQRRWLDGLFFPRAGRFPRGLSPPARPHGRREDVGPGLGLAPSATLVSLSSVSDCNSTRSLLRSDSDEAAPAAPSPPPSPPAPTPTPSPSTNPLVDLELESFKKDPRQSLTPTHVTAACAVSRGHRRTPSDGALGQRGPPEPAGHGPGPRDLLDFPRLPDPQALFPARRRPPEFPGRPTTLTFAPRPRPAASRPRLDPWKLVSFGRTLTISPPSRPDTPESPGPPSVQPTLLDMDMEGQNQDSTVPLCGAHGSH

SEQ ID NO: 171 - protein, 672 aa, Homo sapiens; identical to SEQ ID NO: 33

SEQ ID NO: 172 - protein, 360 aa, Homo sapiens
MAAAAAAGAGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLKHILGILGSPSQEDLNCIINLKARNYLLSLPHKNKVPWNRLFPNADSKALDLLDKMLTFNPHKRIEVEQALAHPYLEQYYDPSDEPIAEAPFKFDMELDDLPKEKLKELIFEETARFQPGYRS

SEQ ID NO: 173 - protein, 646 aa, Homo sapiens
MSFLSRQQPPPPRRAGAACTLRQKLIFSPCSDCEEEEEEEEEEGSGHSTGEDSAFQEPDSPLPPARSPTEPGPERRRSPGPAPGSPGELEEDLLLPGACPGADEAGGGAEGDSWEEEGFGSSSPVKSPAAPYFLGSSFSPVRCGGPGDASPRGCGARRAGEGRRSPRPDHPGTPPHKTFRKLRLFDTPHTPKSLLSKARGIDSSSVKLRGSSLFMDTEKSGKREFDVRQTPQVNINPFTPDSLLLHSSGQCRRRKRTYWNDSCGEDMEASDYELEDETRPAKRITITESNMKSRYTTEFHELEKIGSGEFGSVFKCVKRLDGCIYAIKRSKKPLAGSVDEQNALREVYAHAVLGQHSHVVRYFSAWAEDDHMLIQNEYCNGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRIPQVLSQEFTELLKVMIHPDPERRPSAMALVKHSVLLSASRKSAEQLRIELNAEKFKNSLLQKELKKAQMAKAAAEERALFTDRMATRSTTQSNRTSRLIGKKMNRSVSLTIY

SEQ ID NO: 174 - protein, 472 aa, Homo sapiens
MGSKMNLIEHSHLPTTDEFSFSENLFGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 175 - protein, 694 aa, Homo sapiens
MVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSGKSRPLPV

SEQ ID NO: 176 - protein, 134 aa, Homo sapiens
MEFVMKQALGGATKDMGKMLGGDEEKDPDAAKKEEERQEALRQAEEERKAKYAKMEAEREAVRQGIRDKYGIKKKEEREAEAQAAMEANSEGSLTRPKKAIPPGCGDEVEEEDESILDTVIKYLPGPLQDMLKK

SEQ ID NO: 177 - protein, 399 aa, Homo sapiens
MAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKIPRYKGQGKKKTSGQKAGDKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 178 - protein, 1297 aa, Homo sapiens
MAVPSLWPWGACLPVIFLSLGFGLDTVEVCPSLDIRSEVAELRQLENCSVVEGHLQILLMFTATGEDFRGLSFPRLTQVTDYLLLFRVYGLESLRDLFPNLAVIRGTRLFLGYALVIFEMPHLRDVALPALGAVLRGAVRVEKNQELCHLSTIDWGLLQPAPGANHIVGNKLGEECADVCPGVLGAAGEPCAKTTFSGHTDYRCWTSSHCQRVCPCPHGMACTARGECCHTECLGGCSQPEDPRACVACRHLYFQGACLWACPPGTYQYESWRCVTAERCASLHSVPGRASTFGIHQGSCLAQCPSGFTRNSSSIFCHKCEGLCPKECKVGTKTIDSIQAAQDLVGCTHVEGSLILNLRQGYNLEPQLQHSLGLVETITGFLKIKHSFALVSLGFFKNLKLIRGDAMVDGNYTLYVLDNQNLQQLGSWVAAGLTIPVGKIYFAFNPRLCLEHIYRLEEVTGTRGRQNKAEINPRTNGDRAACQTRTLRFVSNVTEADRILLRWERYEPLEARDLLSFIVYYKESPFQNATEHVGPDACGTQSWNLLDVELPLSRTQEPGVTLASLKPWTQYAVFVRAITLTTEEDSPHQGAQSPIVYLRTLPAAPTVPQDVISTSNSSSHLLVRWKPPTQRNGNLTYYLVLWQRLAEDGDLYLNDYCHRGLRLPTSNNDPRFDGEDGDPEAEMESDCCPCQHPPPGQVLPPLEAQEASFQKKFENFLHNAITIPISPWKVTSINKSPQRDSGRHRRAAGPLRLGGNSSDFEIQEDKVPRERAVLSGLRHFTEYRIDIHACNHAAHTVGCSAATFVFARTMPHREADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLHVLLTATPVGLTLLIVLAALGFFYGKKRNRTLYASVNPEYFSASDMYVPDEWEVPREQISIIRELGQGSFGMVYEGLARGLEAGEESTPVALKTVNELASPRECIEFLKEASVMKAFKCHHVVRLLGVVSQGQPTLVIMELMTRGDLKSHLRSLRPEAENNPGLPQPALGEMIQMAGEIADGMAYLAANKFVHRDLAARNCMVSQDFTVKIGDFGMTRDVYETDYYRKGGKGLLPVRWMAPESLKDGIFTTHSDVWSFGVVLWEIVTLAEQPYQGLSNEQVLKFVMDGGVLEELEGCPLQLQELMSRCWQPNPRLRPSFTHILDSIQEELRPSFRLLSFYYSPECRGARGSLPTTDAEPDSSPTPRDCSPQNGGPGH

SEQ ID NO: 179 - protein, 170 aa, Homo sapiens
MSHRTSSTFRAERSFHSSSSSSSSSTSSSASRALPAQDPPMEKALSMFSDDFGSFMRPHSEPLAFPARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 180 - protein, 296 aa, Homo sapiens
MGCRHSRLSSCKPPKKKRQEPEPEQPPRPEPHELGPLNGDTAITVQLCASEEAERHQKDITRILQQHEEEKKKWAQQVEKERELELRDRLDEQQRVLEGKNEEALQVLRASYEQEKEALTHSFREASSTQQETIDRLTSQLEAFQAKMKRVEESILSRNYKKHIQDYGSPSQFWEQELESLHFVIEMKNERIHELDRRLILMETVKEKNLILEEKITTLQQENEDLHVRSRNQVVLSRQLSEDLLLTREALEKEVQLRRQLQQEKEELLYRVLGANASPAFPLAPVTPTEVSFLAT

SEQ ID NO: 181 - protein, 127 aa, Homo sapiens
MSQGLPAAGSVLQRSVAAPGNQPQPQPQQQSPEDDDRKVRRREKNRVAAQRSRKKQTQKADKLHEEYESLEQENTMLRREIGKLTEELKHLTEALKEHEKMCPLLLCPMNFVPVPPRPDPVAGCLPR

SEQ ID NO: 182 - protein, 264 aa, Homo sapiens
MAGEQKPSSNLLEQFILLAKGTSGSALTALISQVLEAPGVYVFGELLELANVQELAEGANAAYLQLLNLFAYGTYPDYIANKESLPELSTAQQNKLKHLTIVSLASRMKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGLVSSRH

SEQ ID NO: 183 - protein, 200 aa, Homo sapiens
GNLFGRKKQSRVTEQDKAILQLKQQRDKLRQYQKRIAQQLERERALARQLLRDGRKERAKLLLKKKRYQEQLLDRTENQISSLEAMVQSIEFTQIEMKVMEGLQLGNECLNKMHQVMSIEEVERILDETQEAVEYQRQIDELLAGSFTQEDEDAILEELSAITQEQIELPEVPSEPLPEKIPENVPVKARPRQAELVAAS

SEQ ID NO: 184 - protein, 376 aa, Homo sapiens; identical to SEQ ID NO: 65

SEQ ID NO: 185 - protein, 278 aa, Homo sapiens
MELGRGAYGVVEKMRHVPSGQIMAVKRIRATVNSQEQKRLLMDLDISMRTVDCPFTVTFYGALFREGDMWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 186 - protein, 464 aa, Homo sapiens
MSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 187 - protein, 910 aa, Homo sapiens
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 188 - protein, 675 aa, Homo sapiens
MPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGILLGGDYRAEYVPSTPSPVPPSTPLLSAHSKTGSRDCSTQTERGTESNKTAAVAPISVPAPVAAAATAAAITATAATITTTMVAAAPVAVAAAAAPAAAAAPSPATAAATAAAVSPAAAGQIPAAASVASAAAVAPSAAAAAAVQVAPAAPAPVPAPALVPVPAPAAAQASAPAQTQAPTSAPAVAPTPAPTPTPAVAQAEVPASPATGPGPHRLSIPSLTCNPDKTDGPVFHSNTLERKTPIQILGQEPDAEMVEYLI

SEQ ID NO: 189 - protein, 513 aa, Homo sapiens; identical to SEQ ID NO: 122

SEQ ID NO: 190 - protein, 1205 aa, Homo sapiens
MTKKEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSQRPWSGAPETSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 191 - protein, 215 aa, Homo sapiens
MLAGQLEARDPKEGTHPEDPCPGAGAVMEKTAVAAEVLTEDCNTGEMPPLQQQIIRLHQELGRQKSLWADVHGKLRSHIDALREQNMELREKLRALQLQRWKARKKSAASPHAGQESHTLALEPAFGKISPLSADEETIPKYAGHKNQSATLLGQRSSSNNSAPPKPMSLKIERISSWKTPPQENRDKNLSRRRQDRRATPTGRPTPCAERRGGV

SEQ ID NO: 192 - protein, 415 aa, Homo sapiens
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPGLTDQLNPKRDGENSNKPGSATTTEENTSDLEGPVAAGDSSHQENVNVLTKTKGPGDKQKSYQGQSPQKQQTEKANSGNTFKYGQGQVHYQLPDFSKIAPKVKIPKNKIINKPLAIAKQASFSSKSRDKPTLVQDSLETTPESNCVEKQHQEQKGKITEPSQQIQMEPIVHIHQELLTGIESEASLSKLSPTSQKGTSSSSSYIFQKISQGKQMCQKLKEQTDQLKTKVQEFSKRIKQDSPYHLQDKKL

SEQ ID NO: 193 - protein, 145 aa, Homo sapiens
MWSFLPGAESVSMGPVPGVSSLGACWTHDQDSGRAEDRPQAPRITQYTWVLSFLFTEKPQTRSTSPISHQGQPQTTRALSLRQPQHPSAPASGRPRPPHSSGPDLAEAAPVVDQASQAAGRASSGLGLWEQASVSQGFRNAAFEA

SEQ ID NO: 194 - protein, 360 aa, Homo sapiens
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSANGTSSSQLSTPKSKQSPISTPTSPGSLRKHKDLYLPLSLDDSDSLGDSM

SEQ ID NO: 195 - protein, 177 aa, Homo sapiens
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 196 - protein, 466 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 197 - protein, 599 aa, Homo sapiens; identical to SEQ ID NO: 81

What is claimed is:

1. A method for identifying an individual, the method comprising:
   obtaining from the individual a sample of a biological material comprising individual-specific antibodies;
   contacting the sample with an array comprising less than about 200 discriminant proteins determined to be useful in identifying an individual, to bind at least a portion of the individual-specific antibodies to the proteins to form immune complexes, wherein the array comprises at least one of SEQ ID NOs: 81-197;
   applying at least one detection agent to the array, the at least one detection agent comprising at least one interacting protein conjugated to a marker to detect the immune complexes;

removing non-immobilized individual-specific antibodies and unbound detection agent; and detecting the immune complexes on the array, to obtain an antibody profile.

2. The method of claim 1, further comprising comparing the antibody profile to a known antibody profile obtained from an individual.

3. The method according to claim 1, wherein the array comprises each of the proteins of SEQ ID NOs: 1-3, 5, 6, 8, 9, 11, 12, 15-18, 22-24, 26, 27, 29, 33, 38, 41, 44, 46-48, 51, 20, 54, 57-60, 62, 65, 68, 70, 72, 72-75, 77, 79, and 81-145; or each of the proteins of SEQ ID NOs: 1-9, 11-13, 15-20, 22-24, 26-30, 33, 35, 36, 38-41, 44, 46-54, 57-60, 62, 63, 66, 68, 70, 72-80, 82-121, 123-128, 130, 132, 133, 139, 140, 143, and 146-197.

4. The method of claim 1, wherein less than about 170 proteins are immobilized on the support.

5. The method of claim 1, wherein about from 45 to about 166 proteins are immobilized on the support.

6. The method of claim 1, wherein obtaining a sample of the biological material having individual-specific antibodies comprises obtaining a plurality of samples from each of a plurality of individuals.

7. The method of claim 1, wherein each of the proteins is known and wherein each of the proteins is immobilized at a known predetermined location on the support.

8. The method of claim 1, further comprising:
immobilizing less than about 200 proteins on a support to form the array,
wherein immobilizing less than about 200 proteins on a support to form the array comprises applying each of the proteins to the support as a spot having a diameter sufficient to be detected with a color scanner.

9. The method of claim 1, further comprising:
immobilizing less than about 200 proteins on a support to form the array,
wherein immobilizing less than about 200 proteins on a support to form the array further comprises applying each of the proteins as a spot having a diameter of at least 300 microns.

10. The method of claim 1, wherein obtaining a sample of a biological material comprises obtaining a sample of a biological material selected from the group of biological material consisting of tissue, blood, saliva, urine, perspiration, tears, semen, serum, plasma, amniotic fluid, pleural fluid, cerebrospinal fluid, and combinations thereof.

11. The method of claim 1, wherein applying at least one detection agent to the array comprises applying a detection agent comprising at least one interacting protein conjugated to at least one of a chemiluminescent marker, a fluorescent marker, and a colonigenic marker.

12. The method of claim 1, wherein detecting the immune complexes on the array to obtain an antibody profile comprises detecting at least one of a chemiluminescent marker, a fluorescent marker, and a colonigenic marker using a portable device.

13. The method of claim 1, further comprising correlating the antibody profile to a single individual in a population of from about 1 million individuals to about 100 billion individuals.

14. The method of claim 13, wherein correlating the antibody profile to a single individual in a population of from about 1 million individuals to about 100 billion individuals comprises correlating the antibody profile to the single individual in a population of about 10 million individuals.

15. The method of claim 13, wherein correlating the antibody profile to a single individual in a population of from about 1 million individuals to about 100 billion individuals comprises correlating the antibody profile to an individual among a population of less than about 1 million individuals.

16. A method for identifying an individual, the method comprising:
obtaining a plurality of samples of a biological material from each of a plurality of individuals, each of the plurality of samples having individual-specific antibodies;
contacting each of the plurality of samples with an array comprising less than about 200 discriminant proteins determined to be useful in identifying an individual, to bind at least a portion of the individual-specific antibodies to the multiple proteins of the array, to form immune complexes, wherein the array comprises at least one of SEQ ID NOs: 81-197;
applying at least one detection agent to the array, the at least one detection agent comprising at least one interacting protein conjugated to a marker to detect the immune complexes;
removing non-immobilized individual-specific antibodies and unbound detection agent; and
detecting the immune complexes on the array, to obtain an antibody profile.

17. The method of claim 16, further comprising comparing the antibody profile obtained from each of the plurality of individuals to determine a relationship.

\* \* \* \* \*